United States Patent 11,624,072 (CANOLA WITH HIGH OLEIC ACID) - sequence listing, part 6

SEQ ID NO: 32175 - DNA, 350 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagaactcaagaaagcaatcccaccgcactgtttcaaacgctcgatcccacgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32176 - DNA, 349 bp, Artificial
  Mutation in BnaC.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32177 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 32178 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgagtgcggccaccacgccttcagcgactac

SEQ ID NO: 32179 - DNA, 466 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtccaaccgtatggagacggtccagcggctgttgccggtgctgtgccaggcccacggcttgaccccccagcaggtggtggccatcgccagcaatggcggtggcaagcaggcgctggagagaactcaagaaagcaatcccaccgcactgtttcaaacgctcgatccctcgctctttctcctacctcacctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32180 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttaccgcgaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32181 - DNA, 348 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32182 - DNA, 456 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaccacctgctggggggtcaagccgtgggcctggcacagcaccggcaacagccgctggaccgtctccagcgcctgcttgccaccattattgctggcgatggccaccaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32183 - DNA, 444 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgtgggcctggcacagcaccggccaccgcgcctgcaccgtctccagcgctggtttgccacaaatattgctggcgatggccaccacctgctacggagaactcaagaaagcaatcccaccgcactgtttcaaacgctcgatccctcgctctttctcctacctcacctgggacatcatcatagcctcctgcttctactacgtcgccacccctttcttccctctcttccctcaccctctctcctacttcgcctggcctctctactgggcctgccaatggtgcgtcctaaccggcgtctgggtcatagcccacgagtgcggccaccacgccttcagcgactac

SEQ ID NO: 32184 - DNA, 430 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcacgtaccctgcgagacaccgcccttcactgtcgctgtgcctggcccacggcttgaccccccagcaggtggtggccatcgccagcaatggcggtggcaagcaggcgctggagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 32185 - DNA, 419 bp, Artificial
  Mutation in BnaC.FAD2.a introduced by TALE nuclease pair BnFAD2_T03
catgatccatgggtgcaggtggaagaatgcaagtctctcctccctccagctcccccgaaaccaaaaccctcaaacgcgtcccctgcgagacaccacccttcactccggtccagcggctgttgccaccattattgctggcgatggccaccacctgctggggggtcaagccgtgggcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32186 - DNA, 385 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggtcagggtgccggccttgatcatctcgccgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 32187 - DNA, 349 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 32188 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatcttggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32189 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32190 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgacgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 32191 - DNA, 450 bp, Artificial
  Mutation in BnaC.FAD2.a introduced by TALE nuclease pair BnFAD2_T03
caggatccatgggtgcaggtggaagaatgcaagtctctcctccctccagctcccccgaaaccgacaccatcaagcgcgtaccctgcgagacaccgcccttcactgttgagcgatcgttggcgtcggcaaacagtggtccggcgcacgcgctctggaggccttgctcacggtggcgggagagttgagaggtccaccgttacagttggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32192 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgggcctctctactgggcctgccaagggtgcgtcctaaccggcgtctgggtcatagcccgcgagtgcggccaccacgccttcagcgactac

SEQ ID NO: 32193 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttccctcaagaaagcaatcccaccgcactgtttcaaacgctcgattcctcgctctttctcctacctcatctgggacatcatcatagcctcctgcttctactacgtcgccaccacttacttccctctcctccctcaccctctctcctacttcgcctggcctctctactgggcctgtcaagggtgcgtcctaaccggcgtctgggtcatagcccacgagtgcggccaccacgccttcagcgactac

SEQ ID NO: 32194 - DNA, 406 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggctggcgatggccaccacctgctggggggtcaagccgtgggcctggcacagcaccggagaactcaagaaagcaatcccaccgcactgtttcaaacgctcgatccctcgctctttctcctacctcatctgggacataatcatagcctcctgcttctactacgtcgcccccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 32195 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccaccgcactgtttcaaacgctcgatccctcgctctttctcctacctcatctgggacatcatcatagcctcctgcttatactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32196 - DNA, 314 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggcccccacgccttcagcgactac

SEQ ID NO: 32197 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccctcaagcgcgtaccctgcgagacaccgcccttcaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32198 - DNA, 354 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttgcctcgcctggcccctctactgggcctgccaaggctgcgtcctaacgggcctctgggtcatcgcccacgaatgcggccaccacgccttcagcgactac

SEQ ID NO: 32199 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 32200 - DNA, 336 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32201 - DNA, 396 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacggatggccttctgcttagtttgatgcctggcagtttatggcgggcatactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32202 - DNA, 277 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcgatcgagcgtttgaaacagtgcggtgggattgctttcttgagttctccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32203 - DNA, 344 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32204 - DNA, 325 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccctactcaagaaagcaatcccaccgcactgtttcaaacgctcgatccctcgctctttctcctacctcatctgggacatcatcatagcctcctgcttctactacgtcgccaccacttacttccctctcccttacctcgcctgacccctctactgggcctgccaaggctgcgtcctaacgggcctctgggtcatagcccacgagtgcggccaccacgccttcagcgactac

SEQ ID NO: 32205 - DNA, 430 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtattggtaggagttaatattacctaaaaagaaacataaggtaatcaagccgattcattttaagcggcctttcaagcaacaaaaatcacaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32206 - DNA, 354 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 32207 - DNA, 343 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtacactgcgagacaccgcccttcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32208 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttctctctgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32209 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaaacaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32210 - DNA, 452 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggtggccatcgccagcaataatggtggcaggtggtggccatcgccagcaatggcggtggcaagcaggcgctggagacgatccagcggctgttgccggtgcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32211 - DNA, 349 bp, Artificial
  Mutation in BnaC.FAD2.a introduced by TALE nuclease pair BnFAD2_T03
caggatccatgggtgcaggtcgaagaatgcaagtgtctcctccctccaaaaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32212 - DNA, 406 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggctggcgatggccaccacctgctggggggtcaagccgtgggcctggcacagcaccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32213 - DNA, 343 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctcaccggcgtctgggtcatagcccacgagtgcggccaccacgccttcagcgactac

SEQ ID NO: 32214 - DNA, 335 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgcttcaaacgctccatcccacgctccttctcctcttcgacatcatcatctcctcctaggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 32215 - DNA, 277 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32216 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcagccaccacgccttcagcgactac

SEQ ID NO: 32217 - DNA, 384 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcagactgagcctttcgttttatctgttgtttgtcggtgaacgctctcctgagtaggtcaaatccgctctgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 32218 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaagacaagaaggcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32219 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctggcacatcatcatagcctcctgcttctactacgtcgccaccacttacttccctctcctccctcaccctctctcctacttcccctggccactctacagggcctgccatgggtgcggcctaacccgcgtctgggtcatagcccgcgagtgcggccaccacgccttcagcgactac

SEQ ID NO: 32220 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32221 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactgtttcaaacgctcgatccctcgctctttcttctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32222 - DNA, 350 bp, Artificial
  Mutation in BnaC.FAD2.a introduced by TALE nuclease pair BnFAD2_T03
caggatccatgggtgcaggtggatgaatgcaagtctctcctccctccagctcccccggaaccaacaccctcaaacgcgtcccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32223 - DNA, 340 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgttcggctgcggcgagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 32224 - DNA, 319 bp, Artificial
  Mutation in BnaC.FAD2.a introduced by TALE nuclease pair BnFAD2_T03
caggatccatgggtgaaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32225 - DNA, 343 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccgagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctgacccctctactgggcctgccaaggctgcgtcctaacgggcctctgggtcatagcccacgagtgcggccaccacgccttcagcgactac

SEQ ID NO: 32226 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctgacccctctactgggcctgccaagggtgcgtcctaaccggcgtctgggtcatagcccacgagtgcggccaccacgccttcagcgactac

SEQ ID NO: 32227 - DNA, 350 bp, Artificial
  Mutation in BnaC.FAD2.a introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32228 - DNA, 337 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggccatagcccacgagtgcggccaccacgccttcagcgactac

SEQ ID NO: 32229 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32230 - DNA, 341 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccgcgagtgcggccaccacgccttcagcgactac

SEQ ID NO: 32231 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccgtcgtctgggtcatcgcccacgaatgcggccaccacgccttcagcgactac

SEQ ID NO: 32232 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 32233 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctaggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32234 - DNA, 448 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcagcgcctgcttgccgccatcgtggctggcgatggccaccacctgctccggggtcaagccgtgggcctggcacagcaccggcaacagccgctggacggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 32235 - DNA, 345 bp, Artificial
  Mutation in BnaC.FAD2.a introduced by TALE nuclease pair BnFAD2_T03
caggatccatgggtgcatgtggaagaatgcaagtgtctcctccctccaagaagtctgaaaccgacaacatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctactacttcgcctggcctctctactgggcctgccaagggtgcgtcctaaccggcgtctgggtcatagcccacgagtgcggccaccacgccttcagcgactac

SEQ ID NO: 32236 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 32237 - DNA, 271 bp, Artificial
  Mutation in BnaC.FAD2.a introduced by TALE nuclease pair BnFAD2_T03
caggatccatgggtgcaggtggaagaatgcaagtgtctcctccctcccaccgcactgtttcaaacgctcgatccctcgctctttctcctacctcatctgggacatcatcatagcctcctgcttctactacgtcgccaccacttacgtccctctcctccctcaccctctctcctacttcgcctggcctctctactgggcctgccaagggtgcgtcctaaccggcgtctgggtcatagcccacgagtgcggccaccacgccttcagcgactat

SEQ ID NO: 32238 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcgaactcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32239 - DNA, 454 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaccgtctccagcgcctgcttgccaccattattgctggcgatggccaccacctgctccggggtcaagccgtgggcctggcacagcaccggcaacaggcgctggagaagaactcaagaaagcaatcccaccgcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32240 - DNA, 342 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcctctgggtcatagcccacgagtgcggccaccacgccttcagcgactac

SEQ ID NO: 32241 - DNA, 330 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactctcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 32242 - DNA, 347 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32243 - DNA, 312 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 32244 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggtcctcatcatagcctcctgcttctactacgtcgccaccacttacttccctctcctccatcaccctctctcctacttcgcctggcctctctactgggcctgccaagggtgcgtcctaaccggcgtctgggtcatagcccacgagtgcggccaccacgccttcagcgactac

SEQ ID NO: 32245 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccaccgcactgtttcaaacgctcgatccctcgctctttctcctacctcatctgggacatcatcatagcctcctgcttctaatacgtcgccaccacttacttccctctcctccctcaccctctctcctacttcgcctggcctctctactgggcctgccaagggtgcgtcctaaccgtcgtctgggtcatagcccacgagtgcggccaccacgccttcagcgactac

SEQ ID NO: 32246 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 32247 - DNA, 348 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32248 - DNA, 349 bp, Artificial
  Mutation in BnaC.FAD2.a introduced by TALE nuclease pair BnFAD2_T03
caggatccatgggtgcaggtggaacaatgcaagtgtctcctccctccaagaagtctgaaaccgacaccatcaagcgcgtaccctgcgagacaccgcccttcactgtatcatcaagaaagcaatcccaccgcactgtttcaaacgctcgatccctcgctctttctcctacctcatctgggacatcatcatagcctcctggttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32249 - DNA, 338 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctccaaaaacacacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32250 - DNA, 350 bp, Artificial
  Mutation in BnaC.FAD2.a introduced by TALE nuclease pair BnFAD2_T03
caggatccattggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32251 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtacactgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcaggactac

SEQ ID NO: 32252 - DNA, 319 bp, Artificial
  Mutation in BnaC.FAD2.a introduced by TALE nuclease pair BnFAD2_T03
caggatccatgggtgcaggtggaagaatgcaagtctctcctccctccaaccagtctgaaaccgacaccctcaagcgcgtcccctgcgagacaccacccttcactgtttcaaactctcaatccctcgctctttctcctacctcatctgcgacatcctcatagcctccttcttctactacgttgccaccccttacttccctctcctccctcaccctctctcctacttcgcctggcctctctactgggcctgccaagggtgcgtcctaaccggcctctgggtcatcgcccacgagtgcggccaccacgccttcagcgactac

SEQ ID NO: 32253 - DNA, 401 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaaagctggtttgcatgcaggcctctgcagtcgacgggcccgggatccgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32254 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 32255 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 32256 - DNA, 294 bp, Artificial
  Mutation in BnaC.FAD2.a introduced by TALE nuclease pair BnFAD2_T03
caggaccatgggtgcaggtagaagaatgcaagtgtctcctccctccaagaagtctgaaaccgacaccatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32257 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgttgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32258 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgcgacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgggcctctctactgggcctgccaagggtgcgtcctaaccggcgtctgggtcatagcccacgagtgcggccaccacgccttcagcgactac

SEQ ID NO: 32259 - DNA, 385 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggtcagggtgccggccttgatcatctcgccgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32260 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgccgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 32261 - DNA, 356 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 32262 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccaccgcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32263 - DNA, 441 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctgacggatggccttctgcttagtttgatgcctggcagtttatggcgggcggcctgcccgccacccccccggccgttgctgcacaacgttcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgtggccaccacgccttcagcgactac

SEQ ID NO: 32264 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcacgtaccctgcgagacaccgcccttcactgcgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32265 - DNA, 405 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcataccctgcgagacaccgcccttcactgtcggcaacagccgctggaccgtctccagcgcctgcttgccaccattattgctggcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32266 - DNA, 316 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagaactcaagaaagcaatcccaccgcactgtttcaaacgcccgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32267 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcttaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32268 - DNA, 345 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32269 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 32270 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 32271 - DNA, 346 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32272 - DNA, 327 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttccccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 32273 - DNA, 327 bp, Artificial
  Mutation in BnaC.FAD2.a introduced by TALE nuclease pair BnFAD2_T03
caggacccatgggtgcaggtggaagaatgcaagtgtctcctccctccaagaagtctgaaaccgacaccatcaagcgcgtaccctgcgagacaccgcccttccccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32274 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaagggtgcgtcctaaccggcgtctgggtcatagcccacgagtgcggccaccacgccttcagcgactac

SEQ ID NO: 32275 - DNA, 331 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32276 - DNA, 308 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 32277 - DNA, 384 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcggggtcaagccgtgggcctggcacagcaccggcaacaggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 32278 - DNA, 421 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactatttgatgcctggcagttccctactctcgccagcaataatggtggcaagcaggcgctggagacggtccagcggagaactcaagaaagcaatcccaccgcactgtttcaaacgctcgatccctcgctctttctcctacctcatctgggacatcatcatagcctcctgcttctactacgtcgccaccacttacttccctctccgccctcaccctctctcctacttcgcctggcctctctactgggcctgccaagggtgcgtcctaaccggcgtctgggtcatagcccacgagtgcggccacaacgccttcagcgactac

SEQ ID NO: 32279 - DNA, 277 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 32280 - DNA, 415 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcgccagccacgatggcggcaagcaggcgctggagacggtccagcggctgttgccggtgctgtgccagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32281 - DNA, 404 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtctccagcgcctgcttgccgccatcgtggctggcgatggccaccacctgctccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32282 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctccccctctctcctacttcgcctggcctctctactgggcctgccaagggtgcgtcctaaccggcgtctgggtcatagcccacgagtgcggccaccacgccttcagcgactac

SEQ ID NO: 32283 - DNA, 330 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 32284 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtgagaactcaagaaagcaatcccaccgcactgtttcaaacgctccatcccacgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32285 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcacgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32286 - DNA, 348 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32287 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32288 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcccacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32289 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaaggctgaaaccgacaccatcaagcgcgtcccctgcgagacaccgcccttcactgcttcaaacgcgcgagccctcgctctttctcctacctcatctggtacatcatcatagcctcctgcttctactacgtcgcccccacttacttccctctcctccctcaccctctctcctacttcgcctgacccctctactgggcctgccaaggctgcgtcctaacgggcctctgggtcatagcccacgaatgcggcccccacgccttcagcgactac

SEQ ID NO: 32290 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcccctggcctctctactgggcctgccaaggctgcgtcctaacgggcctctgggtcatatcccacgagtgcggccaccacgccttcagcgactac

SEQ ID NO: 32291 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgttgcaaccgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcgtctgggtcatagcccacgagtgcggccaccacgccttcagcgactac

SEQ ID NO: 32292 - DNA, 336 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 32293 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagacctctgaaaccgacaccatcaaacgcgtcccctgcgagacaccacccttcactgagaactcaagaaagcaatcccaccgcactgtttcaatcgctcgatccctcgctctttctcctacctcatctgggacatcatcatagcctcctgcttctactacgtcgccaccgcttacttccctctcctccctcaccctctctcttacctcgcctggcctctctactgggcctgccaagggtgcgtcctaaccggcgtctgggtcatagcccacgagtgcggccaccacgccttcagcgactac

SEQ ID NO: 32294 - DNA, 356 bp, Artificial
  Mutation in BnaC.FAD2.a introduced by TALE nuclease pair BnFAD2_T03
caggatccatgggtgcaggtggaagaatgcaagtgtctcctcctccaagaagtctgaaaccgacaccatcaagcgcgtaccctgcgagacaccgcccttcactgtttttgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32295 - DNA, 282 bp, Artificial
  Mutation in BnaC.FAD2.a introduced by TALE nuclease pair BnFAD2_T03
caggatccatgggtgcaggtggaagaatgcaagtctctagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32296 - DNA, 317 bp, Artificial
  Mutation in BnaC.FAD2.a introduced by TALE nuclease pair BnFAD2_T03
caggatccattggtgcaggtggaagaatgcaagtgtctcctccctccaagaagtctgaaaccgacaccatcaagcgcgtaccctgcgagacacctcccttcactgtcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32297 - DNA, 419 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttgtccagcggctgttgccggtgctgtgccaggcccacggctttacccctcagcaggtggtggccatcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccccgagtgcggccaccacgccttcagcgactac

SEQ ID NO: 32298 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggcttcgtcctaacgggcctctgggtcatcgcccacgaatgcggccaccacgccttcagcgactac

SEQ ID NO: 32299 - DNA, 306 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32300 - DNA, 351 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32301 - DNA, 371 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggtccagcggctgttgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccttgcctctctactgggcctgtcaagggtgcgtcctaaccggcgtctgggtcatagcccacgagtgcggccaccacgccttcagcgactac

SEQ ID NO: 32302 - DNA, 336 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 32303 - DNA, 304 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccctccactgtttcaaacgctcgatccctcgctctttctcctacctcatctgggacatcatcatagcctcctgcttctactacgtcgccaccacttacttccctctcccttacctcgcctgacccctctactgggcctgccaaggctgcgtcctaacgggcctctgggtcatagcccacgagtgcggccaccacgccttcagcgactac

SEQ ID NO: 32304 - DNA, 394 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgttcaaatccgctcccggcggatttgtcctactcaggtgaacgagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgactggcctctctactgggcctgccaagggtgcgtcctaaccggcgtctgggtcatagcccacgagtgcggccaccacgccttcagcgactac

SEQ ID NO: 32305 - DNA, 371 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggtccagcggctgttgccggagaactcaagaaagcaatcccaccgcactgtttcaaacgctcgatccctcgctctttctcctacctcatctgggacatcatcatagcctcctgcttctactacgtcgccacctcttacttccctctcctccctcaccctctctcctacttcgcctggcctctctactgggcctgccaagggtgcgtcctaaccggcgtctgggtcataggccacgagtgcggccaccacgccttcagcgactac

SEQ ID NO: 32306 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 32307 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 32308 - DNA, 314 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32309 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 32310 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 32311 - DNA, 410 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaaaaggagcaattaaaggtactctctaatcctgacctgttggagtttgcttccggtctgagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 32312 - DNA, 397 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttggcggcaacagccgctggaccgtctccagcgcctgcttgccggtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32313 - DNA, 412 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttcaggagagcgttcaccgacaaacaacagataaaacgaaaggcccagtcttccgactgagccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32314 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgaaaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32315 - DNA, 373 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacactgccaggcatcaaactaagcagaaggccatccgtcaaacgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32316 - DNA, 338 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactactcaagaaagcaatcccacctcactgcttcaaacgctccatcccacgctccttctcctcttcgacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32317 - DNA, 342 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32318 - DNA, 333 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32319 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32320 - DNA, 334 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatcgcccgcgaatgcggccaccacgccttcagcgactac

SEQ ID NO: 32321 - DNA, 347 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 32322 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctcccccaccatctcccttacctcgcctggcccctctactgggcctgccaaggctgcgtcctaacgggcctctgggtcatcgcccacgaatgcggccaccacgccttcagcgactac

SEQ ID NO: 32323 - DNA, 348 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 32324 - DNA, 357 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtccgatctagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32325 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactacc

SEQ ID NO: 32326 - DNA, 341 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 32327 - DNA, 295 bp, Artificial
  Mutation in BnaC.FAD2.a introduced by TALE nuclease pair BnFAD2_T03
caggatccatgggtgcaggtggaagaatgcaagtctctcctccctccaggtagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32328 - DNA, 346 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32329 - DNA, 280 bp, Artificial
  Mutation in BnaC.FAD2.a introduced by TALE nuclease pair BnFAD2_T03
caggatccatgggtgcaggtggaagaatgcaagtctcgacctcaagaaagcaatcccaccgcactgtttcaaacgctcgatccctcgctctttctcctacctcatctggcacatcatcatagcctcctgcttctactacgtcgccaccacttacttccctctcctccatcaccctctctcctacttcgcctggcctctctactgggcctgccaagggtgcgtcctaaccggcgtctgggtcatagcccacgagtgcggccaccacgccttcagcgactac

SEQ ID NO: 32330 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctggcacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32331 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32332 - DNA, 351 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccgcgagtgcggccaccacgccttcagcgactac

SEQ ID NO: 32333 - DNA, 281 bp, Artificial
  Mutation in BnaC.FAD2.a introduced by TALE nuclease pair BnFAD2_T03
caggatccatgggtgcaggtggaagaatgcaagtctctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagtgtgcgtcctaaccggcgtctgggtcatagcccacgagtgcggccaccacgcctcagcgactac

SEQ ID NO: 32334 - DNA, 402 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgtgggcctggcacagcaccggcaacagccgctggaccgtctccagcgtctgttgccaccgccattagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 32335 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcctctgggtcatcgcccacgaatgcggccaccacgccttcagcgactac

SEQ ID NO: 32336 - DNA, 345 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcagaactcaagaaagcaatcccaccgcactgtttcaaacgctcgatccctcgctctttctcctacctcatctggtacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 32337 - DNA, 347 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32338 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctccccctggcctctctactgggccggccaagggtgcttcctacccggcgtctgggtcatagcccccgagtgcggccaccacgccttcaccgcctac

SEQ ID NO: 32339 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgcgacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32340 - DNA, 345 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32341 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgtgtcatagcccacgagtgcggccaccacgccttcagcgactac

SEQ ID NO: 32342 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgttctaaccggcgtctgggtcatagcccacgagtgcggccaccacgccttcagcgactac

SEQ ID NO: 32343 - DNA, 338 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 32344 - DNA, 347 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32345 - DNA, 356 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32346 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaataaatcaatccaaccgcactgtttcaaacgctcgatccctctctctttctcctacctcatctgggacatcatcatagcctcctgcttctactacgtccccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32347 - DNA, 352 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 32348 - DNA, 350 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctccctctaccacctctccacagcctacttccctctcctcccccaccctctcccttacctcgcctggcccctctactgggcctgccaaggctgcgtcctaacgggcctctgggtcatcgtccacgaatgcggccaccacgccttcagcgactac

SEQ ID NO: 32349 - DNA, 335 bp, Artificial
  Mutation in BnaC.FAD2.a introduced by TALE nuclease pair BnFAD2_T03
caggacccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 32350 - DNA, 444 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgtgggcctggcacagcaccggcaacagcgcctgcaccgtctccagcgctggtttgccaccaatattgctggcgatggccaccacctgctacggagaactcaagaaagcaatcccaccgcactgtttcaaacgctcgatccctcgctctttctcctacctcatctgggacatcatcatagcctcctgcttctactacgtcgccaccacttacttccctctcttccctcaccctctctcctacttcgcctggcctctctactgggcctgccaagggtgcgtcctaaccggcgtctgggtcatagcccacgagtgcggccaccacgccttcagcgactac

SEQ ID NO: 32351 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttaagcgactac

SEQ ID NO: 32352 - DNA, 348 bp, Artificial
  Mutation in BnaC.FAD2.a introduced by TALE nuclease pair BnFAD2_T03
ccggatccatgggtgcaggtgaaagaatgcaagtgtctcctccctccaaaaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32353 - DNA, 309 bp, Artificial
  Mutation in BnaC.FAD2.a introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32354 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccggaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32355 - DNA, 431 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaccgcgtcccctgcgagacaccaccattcactctcggctgttgccggtgctgtgccaggcccacggcttgaccccggagcaggtggtggccatcgccagccacgatggcggcaagagacctcaagaaagcaatcccacctcactgcttcaaacgctccatcccacgctccttctcctacctcatctgggacatcatcatagcctcctgcttctactacgtcgccaccacgtacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32356 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 32357 - DNA, 349 bp, Artificial
  Mutation in BnaC.FAD2.a introduced by TALE nuclease pair BnFAD2_T03
caggatccatgggtgcaggtgaaagaatgcaagtgtctcctccctccaagaagtctgaaaccgacaccatcaagcacgtaccctgcgagacaccgcccttcactaagaactcaagaaagcaatcccaccgcactgtttcaaacgctcgatccctcgctctttctcctacctcatctgggacatcatcatagcctcctgcttctactacgtcgccacaacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32358 - DNA, 319 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32359 - DNA, 371 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggtccagcggctgttgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32360 - DNA, 335 bp, Artificial
  Mutation in BnaC.FAD2.a introduced by TALE nuclease pair BnFAD2_T03
caggatccatgggtgcaggtggaagaatgcaagtctctcctccctccagctaccctgaaaccaaaaccctcaaacgcgtcccctgcgagacacacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32361 - DNA, 347 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32362 - DNA, 350 bp, Artificial
  Mutation in BnaC.FAD2.a introduced by TALE nuclease pair BnFAD2_T03
caggatccatgggtgcaggtggcagaatgcaagtgtctcctccctccaagaagtcttaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32363 - DNA, 344 bp, Artificial
  Mutation in BnaC.FAD2.a introduced by TALE nuclease pair BnFAD2_T03
gcaggatccatgggtgcagatggaagaatgcaagtgtctcctccctccaagaagtctgaaaccgacaccatcaagcgcgtaccctgcgagacaccgcccttcactgtaagaaagcaatcccactgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgagtgcggccaccacgccttcagcgactac

SEQ ID NO: 32364 - DNA, 282 bp, Artificial
  Mutation in BnaC.FAD2.a introduced by TALE nuclease pair BnFAD2_T03
caggatccatgggtgcaggtggaagaatgcaagtctctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32365 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 32366 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 32367 - DNA, 344 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcacactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32368 - DNA, 354 bp, Artificial
  Mutation in BnaC.FAD2.a introduced by TALE nuclease pair BnFAD2_T03
caggatccatgggtgcaggtggcagaatgcaagtgtctactccctccaagaagtctgaaaccgacaccatcaagcgcgtaccctgcgagacaccgcccttcactggcgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccaccagtgcggccaccacgccttcagcgactac

SEQ ID NO: 32369 - DNA, 406 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcggagccgcttgccgccattgctggcgatggccaccacctgctggggggtcaagccgtgggtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32370 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcggggtcatagcccacgagtgcggccaccacgccttcagcgactac

SEQ ID NO: 32371 - DNA, 411 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcaggtcttgaccccggagcaggtggtggccatcgccagccacgatggcggcaagcaggcgctggagaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgcctggcctctctactgggcctgccaagggtgcgtcctaaccggcgtctgggtcatagcccacgagtgcggccaccacgccttcagcgactac

SEQ ID NO: 32372 - DNA, 319 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 32373 - DNA, 345 bp, Artificial
  Mutation in BnaC.FAD2.a introduced by TALE nuclease pair BnFAD2_T03
caggatccatgggtgcaggtagaagaatgcaagtgtctcctccctccaagaagtctgaaaccgacaccatcaagcgcgtaccctgcgagacaccgcccttcagaactcaagaaagcaatcccaccgcactgtttcgaacgctcgatccctcgctctttctcctacctcatctgggacatcatcatagcctcctgcttctactacgtcgccaccacttacttccctctcctccctcaccctctctcctacttcgcccggcctctctactgggcctgccaagggtgcgtcctaaccggcgtctgggtcatagcccacgagtgcggccaccacgccttcagcgactac

SEQ ID NO: 32374 - DNA, 348 bp, Artificial
  Mutation in BnaC.FAD2.a introduced by TALE nuclease pair BnFAD2_T03
caggatccatgggtgcaggtggaagaatgcaagtctctactccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgacta

SEQ ID NO: 32375 - DNA, 318 bp, Artificial
  Mutation in BnaC.FAD2.a introduced by TALE nuclease pair BnFAD2_T03
caggtccatgggtgcaggtagaagaatgcaagtgtctcctccctccaaaaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32376 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccacactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32377 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgcctggcctctctactgggcctgccaagggtgcgtcctaaccggcgtctgggtcatagcccacgagtgcggccaccacgccttcagcgactac

SEQ ID NO: 32378 - DNA, 341 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccgaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 32379 - DNA, 392 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgtaatctggaacatcgtatgggtaatcgatgaccttacgtttaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32380 - DNA, 341 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 32381 - DNA, 323 bp, Artificial
  Mutation in BnaC.FAD2.a introduced by TALE nuclease pair BnFAD2_T03
caggatccatgggtgcaggtggaagaatgcaagtctctcctccctccagctcccccggaaccaaaaccctcaaacgcgtcccctgcgagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32382 - DNA, 308 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 32383 - DNA, 391 bp, Artificial
  Mutation in BnaC.FAD2.a introduced by TALE nuclease pair BnFAD2_T03
caggatccatgggtgcaggtggcagaatgcaagtctctcctccctccagctcccccggaaccaacaccctcaaacgcgtcccctgcgagacaccacccttcactctaggcgacgaggtggtcgttggtcaacgcggccaacgccgggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32384 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcctcttcgacatcctcgtctcctcctccctctaccacctctccacagcctacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 32385 - DNA, 343 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32386 - DNA, 337 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgggagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 32387 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 32388 - DNA, 425 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgtcgctttccagtcgggaaacctgtcgtgccagctgcattaatgaatcggccaacgcgcggggagaggcggtttgcgtgaactcaagaaagcaaacccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32389 - DNA, 347 bp, Artificial
  Mutation in BnaC.FAD2.a introduced by TALE nuclease pair BnFAD2_T03
caggatccatgggtgcaggtggaagaatgcaagtgtctcctccctccaaaaagcctgaaaccgacaccatcaagcgcgtaccttgcgagacaccgccgttcactaaactcaagaacgcaatcccactgcactgtctcaaccgctctctccctcactctttctcctaccccatctgcgccatcatcatcgcctcctgcttctactacgtcgccaccacctacttccccctcctccctcaccctctctcctacttcgcctggcctctctactgggcctgccaagggtgcgtcctaacgggcctctgggtcatagcccacgagtgcggccaccacgccttcagcgactac

SEQ ID NO: 32390 - DNA, 417 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgtgggcctggcacagcaccggcaacagccgctggaccgtctccagcgcctgcttgccaccgccattagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatagcccacgagtgcggccaccacgccttcagcgactac

SEQ ID NO: 32391 - DNA, 348 bp, Artificial
  Mutation in BnaC.FAD2.a introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32392 - DNA, 408 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggacttcgctgctacccaaggttgccgggcgacgcacaccgtggaaacggatgaaggagacctcaagaaagcaatcccaccgcactgtttcaaacgctcgatccctcgctccttctcctacctcctcttcgacatcctcgtctcctcctccctctaccacctcgccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 32393 - DNA, 357 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctccgccggagacctcaagaaagcaatcccaccgcactgtttcaaacgctcgatccctcgctctttctcctacctcatctggtacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32394 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtatcctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32395 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccatcgctctttctcctacctcatctgggacatcatcatagcctcctgcttctactacgtcgccaccacttacttccctctcctccctcaccctctctcctactccccctggcctctctacggggccggccaaggctgcgtcctaccgggcctcggggtcatagcccgcgagggcggccaccacgccttcaccgactac

SEQ ID NO: 32396 - DNA, 348 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32397 - DNA, 345 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcacaactcaagaaagcaatcccaccgcactgtttcaaacgctcgatccctcgctctttctcctacctcctctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32398 - DNA, 374 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaactccagaaacccgcggctgagtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32399 - DNA, 334 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 32400 - DNA, 338 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32401 - DNA, 338 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 32402 - DNA, 349 bp, Artificial
  Mutation in BnaC.FAD2.a introduced by TALE nuclease pair BnFAD2_T03
caggatccatgggtgcaggtggaacaatgcaagtgtctcctccctccaagaagtctgaaaccgacaccatcaagcgcgtaccctgcgagacaccgcccttcactgtatcatcaagaaagcaatcccaccgcactgtttcaaacgctcgatccctcgctctttctcctacctcatctgggacatcatcatagcctcctggttctactacgtcgccaccacttacttccttctcctccctcaccctctctcctacttcgcctggcctctctactgggcctgccaagggtgcgtcctaaccggcgtctgggtcatagcccacgagtgcggccaccacgccttcagcgactac

SEQ ID NO: 32403 - DNA, 402 bp, Artificial
  Mutation in BnaC.FAD2.a introduced by TALE nuclease pair BnFAD2_T03
caggatccatgggtgcacgtgaaagaatgcaagtgtctcctccatccaagaagactgaaaccgacaccatcaagcgcgtaccctgcgagacaccgcccttcactgtcggggacaagcagtgggcctggcacagcaacggcaagcaggcgccggagacgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccgccacgccttcagcgactac

SEQ ID NO: 32404 - DNA, 342 bp, Artificial
  Mutation in BnaC.FAD2.a introduced by TALE nuclease pair BnFAD2_T03
caggatccatgggtgcaggtggaagaatgcaagtgtctcctccctccagctcccccggaaccaacaccctcaaacgcgtcccctgcgagacaccgcccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32405 - DNA, 347 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 32406 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 32407 - DNA, 348 bp, Artificial
  Mutation in BnaC.FAD2.a introduced by TALE nuclease pair BnFAD2_T03
caggatccatgggtgcaggtggaagaatgcaagtctctcctccctcccgcccccccgaaaccaaacccttcaaccccttccctcgtgagccacaaccctccactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgagcctgccaagggtgcgtcctaaccggcgtctgggtcatagaccacgagtgcggccaccacgcctgcatccactac

SEQ ID NO: 32408 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 32409 - DNA, 347 bp, Artificial
  Mutation in BnaC.FAD2.a introduced by TALE nuclease pair BnFAD2_T03
caggatccatgggtgcaggtgcaagaatgcaagtctctcctccctcccgctcccccgaaaccaaaaccctcaaacgcgtcccctgcgagacaccacccttcactgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32410 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgctcaagaaagcaatcccaccgcactgtttcaaacgctcgatccctcgctctttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32411 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32412 - DNA, 450 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttgagcgatcgttggcgtcggcaaacagtggtccggcgcacgcgctctggaggccttgctcacggtggcgggagagttgagaggtccaccgttacagttggagaactcaagaaagcaatcccaccgcactgtttcaaacgctcgatcccccgctctttcccctccctcatctggcacatcatcatagcctcctgcgtctactacgccgcccccccttactcccctctcccccccccccctctctcctacgtcgcctggcctctctacggggccggccaagggggcgcccgacccggggtcggggtcatagcccaggaaggcggccaccacgccttcagcgactac

SEQ ID NO: 32413 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32414 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32415 - DNA, 280 bp, Artificial
  Mutation in BnaC.FAD2.a introduced by TALE nuclease pair BnFAD2_T03
caggatccatgggtgcaggtggaagaatgcaagtctcgacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32416 - DNA, 319 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32417 - DNA, 327 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacatcaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32418 - DNA, 357 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtttttgttagaactcaagaaagcaatcccaccgcactgtttcaaacgctcgatccctcgctctttctcctacctcatttgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32419 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 32420 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcttctgggtcatagcccacgagtgcggccaccactcctgcagcgactac

SEQ ID NO: 32421 - DNA, 345 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 32422 - DNA, 338 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32423 - DNA, 419 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgttgtccagcggctgttgccggtgctgtgccaggcccacggcttgacccctcagcaggtggtggccatcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32424 - DNA, 339 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaagacctcaagaaagcaatcccaccgcactgtttcaaacgctcgatccctcgctctttctcctacctcatctgggacatcatcatagcctcctgcttctactacgtcgccaccacttacttccctctcctccctcaccccctctcctacttcgcctggcctctctactgggcctgccaagggtgcgtcctaaccggcgtctgggtcatagcccacgagtgcggccaccacgccttcagcgactac

SEQ ID NO: 32425 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32426 - DNA, 277 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32427 - DNA, 341 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtgaaagcaatcccaccgcactgtttcaagcgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32428 - DNA, 331 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32429 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttactaccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32430 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtccgaaaccgacaccataaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32431 - DNA, 349 bp, Artificial
  Mutation in BnaC.FAD2.a introduced by TALE nuclease pair BnFAD2_T03
caggatccatgggtgcaggtggaagaatgcaagtctctactcactccagctcccccggaaccaacacactcaaaagcgtcccctgcgagacaccaccattcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgggcctctctactgggcctgccaaggctgcgtcctaacgggcctccgggtcatagcccacgagtgcgtccaccacgccttcagcgactac

SEQ ID NO: 32432 - DNA, 463 bp, Artificial
  Mutation in BnaC.FAD2.a introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctcggatgatggcataacgcaacgacacgccagtgtgtaaacccgtggccgacccgtgcctcgtgctgcaggtggtggccatcgccagccacgatggcggccacagacgctgcaccgacctcaagaaagcaatcccaccgcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaggggtgcgtcctaacgggcgtctgggtcatagcccacgagtgcggccaccacgccttcagcgactac

SEQ ID NO: 32433 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgccctaaccggcgtctgggtcatagcccacgagtgcggccaccacgccttcagcgactac

SEQ ID NO: 32434 - DNA, 354 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcggtagaactcaagaaagcaatcccaccgcactgtttcaaacgctcgatccctcgctcttcctcctacctcatctgggacctcatcatagcctcctgcttctactacgtcgccaccacttacttccctctcccccctcaccctctctcctacctcgcctggcctctctactgggcctgccaagggtgcgtcctaaccggcgtctgggtcatagcccacgagtgcggccaccacgccttcagcgactac

SEQ ID NO: 32435 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 32436 - DNA, 348 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32437 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgcaagaactcaagaaagcaatcccaccgcactgtttcaaacgctcgatccctcgctctttctcctacctcatctgggacatcatcatagcctcctgcttctactacgtcgccaccacttacttccctctcctccctcatcctctctcctacttcgcctggcctctctactgggcctgccaagggtgcgtcctaaccggcgtctgggtcatagcccacgagtgcggccaccacgccttcagcgactac

SEQ ID NO: 32438 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32439 - DNA, 368 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagcaatggcggtggctggagaactcaagaaaccaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32440 - DNA, 396 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcggttcctggccttttgctggccttttgctcacatgttctttccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32441 - DNA, 347 bp, Artificial
  Mutation in BnaC.FAD2.a introduced by TALE nuclease pair BnFAD2_T03
caggatccatgggtgcaggtggaagaatgcaagtctctcctcccttcagctcccccgaaaccaaaaccctcaaacgcgtcccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32442 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32443 - DNA, 316 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcactcaagaaagcaatcccaccgcactgtttcaaacgctcgatccctcgctctttctcctacctcatctgggacatcatcatagcctcctgcttctactacgtcgccaccgcttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32444 - DNA, 396 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcggttcctggccttttgctggccttttgctcacatgttctttccggagaactcaagaaagcaatcccaccgcactgtttcaaacgctcgatccctcgctctttctcctccctcatctggtacatcctcatagcctcctgcttctactacgtcgcccccacttacttccctcccccccctctccctctctcctacttcgcctggcctctctactgggcctgccaagggtgcgtcctaaccggcgtctgggtcatagcccacgagtgcggccaccacgccttcagcgactac

SEQ ID NO: 32445 - DNA, 347 bp, Artificial
  Mutation in BnaC.FAD2.a introduced by TALE nuclease pair BnFAD2_T03
caggatccatgggtgcaggtggaagaatgcaagtgtctactccctccaaaaagtctgaaaccgacaccatcaagcgcgtaccctgcgagacaccgcccttcactgaactaaagaaagcaatcccaccgcactgtttcaaacgctcgatccctcgctctttctcctacctcatctgggacatcatcatagcctcctgcttctactacgtcgcccccacttacttccctctcctccctcaccctctctcctacttcgcctggcctctctactgggcctgccaagggtgcgtcctaaccggcgtctgggtcatagcccgcgagtgcggccaccacgccttcagcaactac

SEQ ID NO: 32446 - DNA, 319 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccatgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32447 - DNA, 277 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgatcgagcgtttgaaacagtgcggtgggattgctttcttgagttctccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32448 - DNA, 348 bp, Artificial
  Mutation in BnaC.FAD2.a introduced by TALE nuclease pair BnFAD2_T03
caggatcatgggtgcaggtggaagaatgcaagtgtctcctccctccaagaagtctgaaaccgacaccatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgcaaaggctgcggcctaacgggccgctgggtcatagcccacgagtgcggccaccacgccttcagcgactac

SEQ ID NO: 32449 - DNA, 410 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggttcagcctggtcagctgggccttgtagttgcccttgaagtggccggacacgaacaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32450 - DNA, 345 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32451 - DNA, 280 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgtcgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32452 - DNA, 323 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32453 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 32454 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 32455 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactaagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgtcaagggtgcgtcctaaccggcgtctgggtcatagcccacgagtgcggccaccacgccttcagcgactac

SEQ ID NO: 32456 - DNA, 352 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32457 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgtggccaccacgccttcagcgactac

SEQ ID NO: 32458 - DNA, 349 bp, Artificial
  Mutation in BnaC.FAD2.a introduced by TALE nuclease pair BnFAD2_T03
caggatcaatgggtgcaggtggaagaatgcaagtgtctcctccctccaagaagtctgaaaccgacaccatcaagcgcgtaccctgcgagacaccgcccttcactgtcggcggagaactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 32459 - DNA, 411 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaggtcttgaccccggagcaggtggtggccatcgccagccacgatggcggcaagcaggcgctggagaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32460 - DNA, 343 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaacatcaagcgcgtaccctgcgagacaccgccctagacctcaagaaagcaatcccaccgcattgcttcaaacgctccatccctcgctctttctcctacctcatctgggacatcatcatagcctcctgcctctactacgtcgccaccccttacttccctctcctccctcaccctctctcctacttcgcctggcctctctactgggcctgccaagggtgcgtcctaaccggcgtctgggtcatagcccacgagggcggccaccacgccttcagcgactac

SEQ ID NO: 32461 - DNA, 396 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgtacggatggccttctgcttagtttgatgcctggcagtttatggcgggcatactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 32462 - DNA, 345 bp, Artificial
  Mutation in BnaC.FAD2.a introduced by TALE nuclease pair BnFAD2_T03
caggatccatgggtgcaggtggaacaatgcaagtgtctcctccctcaaagaagtctgaaaccgacaccatcaagcgcgtaccctgcgagacaccgcccttcactgtacaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32463 - DNA, 348 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32464 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32465 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32466 - DNA, 350 bp, Artificial
  Mutation in BnaC.FAD2.a introduced by TALE nuclease pair BnFAD2_T03
caggaccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32467 - DNA, 308 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctctttcacctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32468 - DNA, 332 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactatcccaccgcactgtttcaaacgctcgatccctcgctctttctcctacctcatctgggacatcatcatagcctcctgcttcaactacgtcgccaccacttacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 32469 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccaacttcgcctggcctctctactgggcctgccaagggtgcgtcctaaccggcgtctgggtcatagcccacgagtgcggccaccacgccttcagcgactac

SEQ ID NO: 32470 - DNA, 348 bp, Artificial
  Mutation in BnaC.FAD2.a introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32471 - DNA, 348 bp, Artificial
  Mutation in BnaC.FAD2.a introduced by TALE nuclease pair BnFAD2_T03
caggattccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32472 - DNA, 349 bp, Artificial
  Mutation in BnaC.FAD2.a introduced by TALE nuclease pair BnFAD2_T03
caggatccatgggtgcaggtgcaagaatgcaagtgtcacctccctccaagaagtctgaaaccgacaccatcaagcgcgtaccctgcgagacaccgcccttcactgtagactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 32473 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttctctcaagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32474 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagacgtctgaaaccgacaccctcaagcgcgtaccctgcgagacaccacccttcactgagaactccagcaagcaatcccaccgccctgtttcaaacgctcgctccctcgctctttctcccacctcatctgcgtcatcatcatagcctcctccttctactccgtcgcctcctctcacttccctctcctccctcaccctctcccctacctcgcctggcctctctactgggcctgccaagggtgcgtcctaaccggcctctgggtcatagcccacgagtgcggccaccacgccttcagcgactac

SEQ ID NO: 32475 - DNA, 343 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32476 - DNA, 368 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagcaatggcggtggctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 32477 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacacaataaggggggacccctgcgagaccccgccttccactgtgagatctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32478 - DNA, 350 bp, Artificial
  Mutation in BnaC.FAD2.a introduced by TALE nuclease pair BnFAD2_T03
caggatccatgggtgcaggtggaagaatgcaagtgtctcctcccttcaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32479 - DNA, 342 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32480 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttccctcaagaaagcaatcccaccgcactgtttcaaacgctcgatccctcgctctttctcctaccccatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 32481 - DNA, 280 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 32482 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagggcggccaccacgccttcagcgactac

SEQ ID NO: 32483 - DNA, 335 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 32484 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32485 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaaacgcgtaccctgcgagacaccgcccttcactgtagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32486 - DNA, 452 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaatggcggtggcaagcaggcgctggagacggtccagcggctgttgccggttctgttcccggcccacggcttgaccccggagccggtggtggccaccgccatggagaactcaagaaagcaatcccaacgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32487 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgttgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32488 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccaccgcactgtttcaaacgctcgatccctcgctctttctcatacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32489 - DNA, 314 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32490 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32491 - DNA, 396 bp, Artificial
  Mutation in BnaC.FAD2.a introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactctgtggccatcgccagcaatggcggtggcaagcaggcgctggagacggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32492 - DNA, 347 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 32493 - DNA, 331 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32494 - DNA, 317 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 32495 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcaccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32496 - DNA, 350 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 32497 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32498 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttagaactcaagaaagcaatcccaccgcactgtttcaaacgctcgatccctcgctccttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 32499 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtcccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 32500 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgtcggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32501 - DNA, 381 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacggatggccttctgcttagtttgatgcctggcagtttatggcgggcatactcaagaaagcaatcccaccgcactgtttcaaacgctcgatccctcgctctttctcctacctcatctgggacatcatcatagcctcctgcttctactacgtcgccaccacttactgccctctcccttacctcgcctgacccctctactgggcctgccaaggctgcgtcctaacgggcctctgggtcatagcccacgagtgcggccaccacgccttcagcgactac

SEQ ID NO: 32502 - DNA, 295 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcctctgggtcatagcccacgagtgcggccaccacgccttcagcgactac

SEQ ID NO: 32503 - DNA, 385 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggtcagggtgccggccttgatcatctcgccgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccggcctctctactgggcctgccaagggtgcgtcctaaccggcgtctgggtcatagcccacgagtgcggccaccacgccttcagcgactac

SEQ ID NO: 32504 - DNA, 331 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactatcccaccgcactgtttcaaacgctcgatccctcgctctttctcctacctcatctgagacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgacac

SEQ ID NO: 32505 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32506 - DNA, 394 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgccggtgctgtgccaggcccacggcttgaccccccagcaggtggtgggaactcaagaaagcaatcccaccgcactgtttcaaacgctcgatccctcgctctttctcctacctcatctgggacatcatcatagcctcctgcttctactacgtcgccaccacttacttccctctcatccctcaccctctctcctacttcgcctggcctctctactgggcctgccaagggtgcgtcctaaccggcgtctgggtcatagcccacgagtgcggccaccacgccttcagcgactac

SEQ ID NO: 32507 - DNA, 357 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgtttttgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32508 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 32509 - DNA, 350 bp, Artificial
  Mutation in BnaC.FAD2.a introduced by TALE nuclease pair BnFAD2_T03
caggatccatgggtgcaggtggaagaatgcaagtctctcctccctccaaaacgtctgaaaccgacaccatcaagcgcgtaccctgcgagacaccgcccttcactgtcgaacccaagaaagcaatcccaccgcactatttccaacactctatccctcgctctttctcctacctcatctcgcccatcatcatagcctcctgcttctactacgtcgccacctcttacttccctctcctcccttaccctctcccctacctcgcctggcccctctactgggcctgccaagggtgcgtcctaaccggcgtctgggtcatagcccacgagtgcggccaccacgccttcagcgactac

SEQ ID NO: 32510 - DNA, 347 bp, Artificial
  Mutation in BnaC.FAD2.a introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcacagacctcaagaaagcaatcccaccgcactgtttcaaacgctcgatccctcgctctttctcctacctcatctgggacatcatcatagcctcctgcttctactacgtcgccaccactgacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32511 - DNA, 348 bp, Artificial
  Mutation in BnaC.FAD2.a introduced by TALE nuclease pair BnFAD2_T03
caggatccatgggtgcaggtggaagaatgcaagtctctcctccctccaagacgcctgaaaccgacaccatcaaacgcgtaccctgcgagacaccacccttcactggcactcaagaaagcaatcccaccgcactgtttcaaacgctcgatccctcgctctttctcctacctcatctgcgacatcatcatcgcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32512 - DNA, 411 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgtacgtgccccacgagtacatcgagctgatcgagatcgcccggaacagcacccaggaccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32513 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcagcgcccacgaatgcggccaccacgccttcagcgactac

SEQ ID NO: 32514 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32515 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggatgcgtcctaaccggcgtctgggtcatagcccacgagtgcggccaccacgccttcagcgactac

SEQ ID NO: 32516 - DNA, 345 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacgcctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 32517 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggttatagcccacgagtgcggccaccacgccttcagcgactac

SEQ ID NO: 32518 - DNA, 393 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacacgcctgcttgccgccatcgtggctggcgatggccaccacctgctcctggcacagcagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 32519 - DNA, 317 bp, Artificial
  Mutation in BnaC.FAD2.a introduced by TALE nuclease pair BnFAD2_T03
caggatccatgggtgcaggtggaagaatgcaagtgtatactccctccaagaagtctgaaaccgacaccatcaagcgcgtaccctgcgagacaccgcccttcactgtcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcctctgggtcatagcccacgagtgcggccaccacgccttcagcgactac

SEQ ID NO: 32520 - DNA, 352 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaaccggcctctgggtcatcgcccacgaatgcggccaccacgccttcagcgactac

SEQ ID NO: 32521 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttccactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 32522 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccatgcgagacaccacccttcactcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32523 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgcctggcctctctactgggcctgccaagcctgcgtcctaacgggcctctgggtcatagcccacgagtgcggccaccacgccttcagcgactac

SEQ ID NO: 32524 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 32525 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32526 - DNA, 349 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32527 - DNA, 287 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacacagcccttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 32528 - DNA, 350 bp, Artificial
  Mutation in BnaC.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactgtaaaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactggtcctgccaaggctgcgtcctaacgggcctctgggtcatcgcccacgaatgcggccaccacgcctgcagcgactac

SEQ ID NO: 32529 - DNA, 335 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactaggcctgccaaggctgcgtcctaacgggcctctgggtcatagcccacgagtgcggccaccacgccttcagcgactac

SEQ ID NO: 32530 - DNA, 356 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32531 - DNA, 348 bp, Artificial
  Mutation in BnaC.FAD2.a introduced by TALE nuclease pair BnFAD2_T03
caggatccatgggtgcaggtggaagaatgcaagtatctcctccctccaagaagtctgaaaccgacaccatcaagagcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctatccggcgtctgggtcatagcccacgagtgcggccaccacgccttcagcgactac

SEQ ID NO: 32532 - DNA, 350 bp, Artificial
  Mutation in BnaC.FAD2.a introduced by TALE nuclease pair BnFAD2_T03
caggatccatgggtgcaggtggaagaatgcaagtgtctcctccctccagcaaccctgaaaccgacaccatcaaacgcgtcccctgcgagacaccgcccttcactgtagaactcaagaagacaatcccaccgcactgttgcaaacgctccatccctcgctctttctcctacctcatctgggacatcatcatcgcctcctgcttctactacctcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32533 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 32534 - DNA, 335 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctccttctcctcttcgacatcatcatctcctcctcggctcctccctctaccacctctccacagcctacttccctctcccttacctcgcctgaccccgctacagagcctgccaaggctgcgtcctaacgggcctctgggtcatagcccacgagtgcggccaccacgccttcagcgactac

SEQ ID NO: 32535 - DNA, 324 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32536 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccgacaccatcaagcgcgtaccctgcgagacaccgcccttcactatgaacccaagcaagcaatcacaccacactgtttcaaacgctcgatccctcccgctttctcctacctcatctgggccatcatcatagcctcctgcttctacgacgtcgccaccacctacttccctctcctccctctccctctctcctacttcgcctggcctctctactgggcctgccaagggtgcgtcctaacgggcctctgggtcatagcccacgagtgcggccaccacgccttcagcgactac

SEQ ID NO: 32537 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32538 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32539 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 32540 - DNA, 332 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 32541 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccaccacactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32542 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacaagaaagcaatcccaccgcactgttgcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32543 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 32544 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgacctcaagaaagcaatcccacctcactgcttcaaacgctccatcccacgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 32545 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacactcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32546 - DNA, 324 bp, Artificial
  Mutation in BnaC.FAD2.a introduced by TALE nuclease pair BnFAD2_T03
caggatccatgggtgcaggtggaagaatgcaagtgtctcctccctccagctcccccggaaccaacaccctcaaacgcgtcccctacaagacctcaagaaagcaatcccacctcactgcttcaaacgctacatcccacgctccttctcctcttcgacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32547 - DNA, 308 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccactagtgcggccaccacgccttcagcgactac

SEQ ID NO: 32548 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttatcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32549 - DNA, 349 bp, Artificial
  Mutation in BnaC.FAD2.a introduced by TALE nuclease pair BnFAD2_T03
caggatcatgggtgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 32550 - DNA, 351 bp, Artificial
  Mutation in BnaC.FAD2.a introduced by TALE nuclease pair BnFAD2_T03
caggatccatgggtgcaggtgtaagaatgcaagtgtctcctccctccaagaagtctgaaaccgacaccatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32551 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32552 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32553 - DNA, 315 bp, Artificial
  Mutation in BnaC.FAD2.a introduced by TALE nuclease pair BnFAD2_T03
caggatccatgggtcaggtggaagaatgcaagtgtctcctccctacaagaagcctgaaaccgacaccctcaaacgcgtcccctgcgatacaccaccattcactccggagacctcaagaaagcaatcccacctcactgcttcaaacgctccatcccacgctccttctcctcttcgacatcatcctctcctcctcggctcctccctcaccctctctcctacttcgcctggcctctctactgggcctgccaagggtgcgtcctaaccggcgtctgggtcatagcccacgaatgcggccaccacgccatcagcgactac

SEQ ID NO: 32554 - DNA, 452 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaatggcggtggcaagcaggcgctggagacggtccagcggctgttgccggtgctgtgccaggcccacagcttgaccccggagcagggggcggccaccgccatggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32555 - DNA, 334 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactgagaactcaagaaagcaatcccaccgcactgtttcaaacgctcgatccctcgctctttctcctacctcatctgggacatcatcatagcctcctgcttctactacgtcgccaccacttacttccctctcccttacctcgcctgacccctctactgggcctgccaaggctgcgtcctaacgggcctctgggtcatagcccacgagtgcggccaccacgccttcagcgactac

SEQ ID NO: 32556 - DNA, 383 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttaagcgcggcgggtgtgggggttacgcgcataagtgaagggcggtgtaacaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32557 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32558 - DNA, 347 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32559 - DNA, 323 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32560 - DNA, 408 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggccagttaccttcggaaaaagagttggtagctcttgatccggcaaacaaaccaccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcataacccacgagtgcggccaccacgccttcagcactac

SEQ ID NO: 32561 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32562 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccatcaccctctctcctacttcgcctggcctctctactgggcctgccaagggtgcgtcctaaccggcgtctgggtcatagcccacgagtgcggccaccacgccttcagcgactac

SEQ ID NO: 32563 - DNA, 347 bp, Artificial
  Mutation in BnaC.FAD2.a introduced by TALE nuclease pair BnFAD2_T03
caggatccatgggtgcagggggaagaatgcaagtgtctcctccctccaagaagtctgaaaccgacaccatcaagcgcgtaccctgcgagacaccgcccttcactcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32564 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacgtggcctgccaagggtgcgtcctaacgggcctcggggtcatagcccacgagtgcggccaccacgccttcagcgactac

SEQ ID NO: 32565 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 32566 - DNA, 428 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggtgctgtgccaggcccacggcttgaccccggagcaggtggtggccatcgccagccacgatggcggcaagcaggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32567 - DNA, 341 bp, Artificial
  Mutation in BnaC.FAD2.a introduced by TALE nuclease pair BnFAD2_T03
cagtatccatgggtgcaggtggaagaatgcaagtgtctcctccctccaagaagtctgaaaccgacaccatcaagcgcgtaccctgcgagacaccgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32568 - DNA, 346 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacgacctcaagaaagcaatcccaccgcactgtttcaaacgctcgatccatcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32569 - DNA, 462 bp, Artificial
  Mutation in BnaC.FAD2.a introduced by TALE nuclease pair BnFAD2_T03
caggatccatgggtgcaggtggaagaatgcaagtgtctcctccctccaaaagtctgaaaccgacaacatcaagcgcgtaccctgcgagacaccgcccttcactgtcggggtcaagccgtgggcctggcacagcaccggcaacagccgctggaccgtctccagcgcctgcttgccaccattattgctggcgatggccaccacctgctggggggtcaagtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32570 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggtcaccacgccttcagcgactac

SEQ ID NO: 32571 - DNA, 305 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 32572 - DNA, 350 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32573 - DNA, 345 bp, Artificial
  Mutation in BnaC.FAD2.a introduced by TALE nuclease pair BnFAD2_T03
caggatccatgggtgcaggtggaagaatgcaagtctctcctccctccaaaaagtctgaaaccgacaccatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32574 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32575 - DNA, 314 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 32576 - DNA, 344 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccatagcctttctagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32577 - DNA, 346 bp, Artificial
  Mutation in BnaC.FAD2.a introduced by TALE nuclease pair BnFAD2_T03
caggatccatgggtgcaggtggaagaatgcaagtgtctcctacctccaagaagtctgaaaccgacaccatcaagcgcgtaccctgcgagacaccgcccttcactaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32578 - DNA, 348 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgcctcagcgactac

SEQ ID NO: 32579 - DNA, 419 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtccgactgagcctttcgttttatctgttgtttgtcggtgaacgctctcctgagtaggacaaatccgccggagaactcaagaaagcaatcccaccgcactgtttcaaacgctcgatccctcgctctttctcctacctcatctgggacatcatcataggctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32580 - DNA, 336 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 32581 - DNA, 277 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgataccatcaagcgcgtaccctgcgagacaccgcccttcactgtcgatcgagcgtttgaaacagtgcggtgggattgctttcttgagttctccctctcctccctcaccctctctcctacttcgcctggcctctctactgggcctgccaagggtgcgtcctaaccggcctctgggtcatagcccacgagtgcggccaccacgccttcagcgactac

SEQ ID NO: 32582 - DNA, 277 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgggacatcatcatagcctcctgcttctactacgtcgccaccacttacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 32583 - DNA, 349 bp, Artificial
  Mutation in BnaC.FAD2.a introduced by TALE nuclease pair BnFAD2_T03
caggatccatgggtgcaggtggaagaatgcaagtctctcctccctcaagctcccccggaaccaacaccctaaaccgcgtcccctgcgagacaccaccattcacttagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcgtccaccacgccttcagcgactac

SEQ ID NO: 32584 - DNA, 344 bp, Artificial
  Mutation in BnaC.FAD2.a introduced by TALE nuclease pair BnFAD2_T03
caggatccatgggtgcaggtggaagaatgcaagtctctcctcactccaagaagtctgaaaccgacaccatcaagcgcgtaccctgcgagacaccgcccttcgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctagcctctctactgggcctgccaagggtgcgtcctaaccggcgtctgggtcatagcccacgagtgcggccaccacgccttcagcgactac

SEQ ID NO: 32585 - DNA, 416 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgcccacggcttgaccccggagcaggtggtggccatcgccagccacgatggcggcaagcaggcgctggaagaactcaagaaagcaatcccaccgcactgtttcaaacgctcgatccctcgctctttctcctacctcatctgggacatcatcatagcctcctgcttctactacgtcgcccccacttacttccctctcctccctcaccctctctccttcttcgcctggcctctctactggtcctgccaagggtgcgtcctaaccggcgtctgggtcatagcccacgagtgcggccaccacgccttcagcgactac

SEQ ID NO: 32586 - DNA, 341 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32587 - DNA, 343 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaactcaagaaagcaatcccaccgcactgtttcaaacgctcgatccctcgctctttctcctacctcatctgggacatcatcatagcctcctgcttctactacgtcgccaccacttacttccatctcctccctcaccctctctcctacttcgcctggcctctctactgggcctgccaagggtgcgtcctaaccggcgtctgggtcatagcccacgagtgcggccaccacgccttcagcgactac

SEQ ID NO: 32588 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccccctctcctacttcgcctggcctctctactgggcctgccaaggctgcgtcctaacgggcctctgggtcatagcccacgagtgtggccaccacgccttcagcgactac

SEQ ID NO: 32589 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 32590 - DNA, 349 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccgcttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32591 - DNA, 351 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32592 - DNA, 282 bp, Artificial
  Mutation in BnaC.FAD2.a introduced by TALE nuclease pair BnFAD2_T03
caggatccatgggtgcaggtggaagaatgcaagtctctagacctcaagaaagcaatcccaccgcactgtttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32593 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32594 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctaatgggcctgccaagggtgcgtcctaaccggcgtctgggtcatagcccacgagtgcggccaccacgccttcagcgactac

SEQ ID NO: 32595 - DNA, 376 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactcgctcggtcgttcggctgcggcgagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgaatgcggccaccacgccttcagcgactac

SEQ ID NO: 32596 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 32597 - DNA, 409 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggccagttaccttcggaaaaagagttggtagctcttgatccggcaaacaaaccaccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgtgtcctaaccggcgtctgggtcatagcccacgagtgcggccaccacgccttcagcgactac

SEQ ID NO: 32598 - DNA, 355 bp, Artificial
  Mutation in BnaC.FAD2.a introduced by TALE nuclease pair BnFAD2_T03
caggatccatgggtgcaggtggaagaatgcaagtgtctcctcccttcaagaagtctgaaaccgacaccatcaagcgcgtaccctgcgagacaccgcccttcactgtcgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttcgcctggcctctctactgggcctgccaagggtgcgtcctaaccggcgtctggggcatagcccacgagtgcggccaccacgccttcagcgactac

SEQ ID NO: 32599 - DNA, 430 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaaacgcgtaccctgcgaaacaccgcccttccatttggtacaccgccctacaccgcccttcacacgcccgccataaactgccaggcatcaaactaagcagaaggccatcctgacggagaactcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32600 - DNA, 331 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacaagaaagcaaccccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 32601 - DNA, 371 bp, Artificial
  Mutation in BnaC.FAD2.a introduced by TALE nuclease pair BnFAD2_T03
caggatccatgggtgcaggtggaagaatgcaagtctctcctccctccagctcccccgaaaccgacaccatcaagcgcgtaccctgcgagacaccgcccttcactgttttgacggggtcagtgccttaagtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32602 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagactgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32603 - DNA, 409 bp, Artificial
  Mutation in BnaC.FAD2.a introduced by TALE nuclease pair BnFAD2_T03
caggatccatgggtgcaggtggaagaatgcaagtgtctcctcactccaagaagtctgaaaccgacaccatcaagcgcgtaccctgcgagacaccgcccttcactgtcaggcccacggcttgaccccggagcaggtggtggccatcgccagcaatattggtggcggagaactcaagaaagcaattccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32604 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32605 - DNA, 354 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgattgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 32606 - DNA, 319 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccacccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32607 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 32608 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagtgtgcgtcctaaccggcgtctgggtcatagcccacgagtgcggccaccacgccttcagcgactac

SEQ ID NO: 32609 - DNA, 318 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32610 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccctcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32611 - DNA, 423 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcgatggccaccacctgctccggggtcaagccgtgggcctggcacagcaccggcaacaggcgctggagactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32612 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32613 - DNA, 348 bp, Artificial
  Mutation in BnaC.FAD2.a introduced by TALE nuclease pair BnFAD2_T03
caggatccatgggtgcaggtggaagaatgcaagtgtctcctccctcaaagaagtctgaaaccgacaccatcaagcgcgtaccctgcgagacaccgcccttcactgtagctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcgaccaccacgccttcagcgactac

SEQ ID NO: 32614 - DNA, 337 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32615 - DNA, 349 bp, Artificial
  Mutation in BnaC.FAD2.a introduced by TALE nuclease pair BnFAD2_T03
caggatccatgggtgcaggtggaagaatgcaagtgtctcctccctccaaaaagcctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32616 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccctccactgtagaactcaagaaagcaatcccaccgcactgttgcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 32617 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacctggcctctctactgggcctgccaagggtgcgtcctaaccggcgtctgggtcatagcccacgagtgcggccaacacgccttcagcgactac

SEQ ID NO: 32618 - DNA, 436 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgggcttgaccccccagcaggtggtggccatcgccagcaataatggtggcaagcaggcgctggagacggtccagcggctgttgccggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 32619 - DNA, 381 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttaactctgaatgcatctagatccaatgatcatgagcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 32620 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgagacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32621 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaaccggcgtctgggtcatagcccacgagtgcggccaccacgccttcagcgactac

SEQ ID NO: 32622 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgcgctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32623 - DNA, 468 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggattgcaaaacgtggcggcgtgaccgcagtggaggcagtgcatgcatggcgcaatgcactgacgggtgccccgctcaacttgaccccccagcaggtggtggccatcgccagcacggagaactcaagaaagcaatcccaccgcactgtttcaaccgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32624 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 32625 - DNA, 277 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcgatcgagcgtttgaaacagtgcggtgggattgctttcttgagttctccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 32626 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtatgggtcatagcccacgagtgcggccaccacgccttcagcgactac

SEQ ID NO: 32627 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcagaactcaagaaagcaatcccaccgcactgtttcaaacgctcgatccctcgctctttctcctacctcatctggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32628 - DNA, 335 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcccttacctcgcctgacccctctactgggcctgccaaggctgcgtcctaacgggcctctgggtcatagcccacgagtgcggccaccacgccttcagcgactac

SEQ ID NO: 32629 - DNA, 277 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 32630 - DNA, 347 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcatggcctctctactgggcctgccaagggtgcgtcctaacgggcctctgggtcatcgcccacgaatgcggccaccacgccttcagcgactac

SEQ ID NO: 32631 - DNA, 339 bp, Artificial
  Mutation in BnaC.FAD2.a introduced by TALE nuclease pair BnFAD2_T03
caggatccatgggtgaggtggaagaatgcaagtgtctcctccctccaagaagtctgaaaccgacaccatcaagcgcgtacggctgcggcgagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32632 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32633 - DNA, 412 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtgtacgtgccccacgagtacatcgagctgatcgagatcgcccggaacagcacccaggaccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttccagcgactac

SEQ ID NO: 32634 - DNA, 349 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtcccctgcgagacaccgcccttcactgagaactcccgaaagcaatcccaccgcactgtttcaaacgctcgatccctcgctctttctcctacctcatctgggacatcatcatatcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 32635 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccattaagccacgatggcggcaagcaggcgctggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 32636 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaatcctcaaacgcgtcccctgcgagacaccacccttcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32637 - DNA, 395 bp, Artificial
  Mutation in BnaC.FAD2.a introduced by TALE nuclease pair BnFAD2_T03
caggatccatgggtgcaggtggaggaatgcaagtgtctcctccctccaagaagtctgaaaccgacaccatcaagcgcgtaccctgcgagacaccgcccttcactggtggccatcgccagcaatggcggtggcaagcaggcgctggagacggagaactcaagaaagcaatcccaccgcactgtttcaaacgctcgatccctcgctctttctcctacctcatctgggacatcatcatagcctcctgcttctactacgtcgccaccacttacttccctctcctccctaaccctctctcctacttcgcctggcctctctactgggcctgccaagggtgcgtcctaaccggcgtctgggtcatagcccacgagtgcggccaccacgccttcagcgactac

SEQ ID NO: 32638 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctggcacatcatcatatcctcctgcttctactacgtcgccaccacttacttccctctcctccctcaccctctctcctacctcgcctggcctctctactgggcctgccaagggtgcgtcctaaccggcgtctgggtcatagcccacgagtgcggccaccacgccttcagcgactac

SEQ ID NO: 32639 - DNA, 369 bp, Artificial
  Mutation in BnaC.FAD2.a introduced by TALE nuclease pair BnFAD2_T03
caggatccatgggtgcaggtggaataatgcaagtgtctcctccctccaagaagtctgaaaccgacaccatcaagcgcgtaccctgcgagacaccgcccttcactgtacggtggtttgtttgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgtggccaccacgccttcagcgactac

SEQ ID NO: 32640 - DNA, 342 bp, Artificial
  Mutation in BnaC.FAD2.a introduced by TALE nuclease pair BnFAD2_T03
caggatccatgggtgcaggtggcagaatgcaagtgtctcctacctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32641 - DNA, 450 bp, Artificial
  Mutation in BnaC.FAD2.a introduced by TALE nuclease pair BnFAD2_T03
caggatccatgagtgcaggtggaagaatgcaagtgtctcctccctccaagaagtctgaaaccgacaccatcaagcgcgtaccctgcgagacaccgcccttcactgttgagcgatcgttggcgtcggcaaacagtggtccggcgcacgcgctctggaggccttgctcacggtggcgggagagttgaggggtccaccgttacagttggagaaatcaagaaagcaatcccaccgcactgtttcaaacgctcgatccctcgctctttctcctacctcaactgggacatcatcatagcctccagcttctactacggcgccaccgcttacttcccgctcctccctcaccctctctcctacttcgcctggcctctctactgggcctgccaagggtgcgtcctaaccggcgtctgggtcatagcccacgagtgcggccaccgcgccttcagcaactac

SEQ ID NO: 32642 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaatgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 32643 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggtcaccacgccttcagcgactac

SEQ ID NO: 32644 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 32645 - DNA, 345 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32646 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 32647 - DNA, 287 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacacagcccttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 32648 - DNA, 419 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttggggggtcaagccgtgggcctggcacagcaccggcaacagccgctggaccgtctccagcgcctgcttgagacctcaagaaagcaatcccacctcactgcttcaaacgctccatccctcgctctttctcctacctcatctgggacatcatcatagcctcctgcttctactacgtcgccaccacttacttccctctcctccctcaccctctctcatacttcgcctggcctctctactgggcctgccaagggtgcgtcctaaccggcgtctgggtcatagcccacgagtgcggccaccacgccttcagcgactac

SEQ ID NO: 32649 - DNA, 346 bp, Artificial
  Mutation in BnaC.FAD2.a introduced by TALE nuclease pair BnFAD2_T03
caggatccatgggtgcaggtggaagaatgcaagtgtctcctccctcccagaagtctgaaaccgacaccatcaagcgcgtaccctgcgagacaccgcccttcactgtctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32650 - DNA, 349 bp, Artificial
  Mutation in BnaC.FAD2.a introduced by TALE nuclease pair BnFAD2_T03
caggatccatgggtgcaggtggcagaatgcaagtgtctcctcccttcaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccggccaaggctgcgtcctaacgggcctctgggtcatagcccacgagtgcggccaccacgccttcagcaactac

SEQ ID NO: 32651 - DNA, 349 bp, Artificial
  Mutation in BnaC.FAD2.a introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32652 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctcacccaccctctcccttgcctcgcctggcccctctcctgggcctgccaaggctgcgtcctaacgggcctctgggtcatcgcccacgaatgcggccaccacgccttcagcgactac

SEQ ID NO: 32653 - DNA, 401 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttgaccccggagcaggtggtggccatcgccagccacgatggcggcaagcaggcgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32654 - DNA, 277 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtcgatcgagcgtttgaaacagtgcggtgggattgctttcttgagttctccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32655 - DNA, 349 bp, Artificial
  Mutation in BnaC.FAD2.a introduced by TALE nuclease pair BnFAD2_T03
taggatccatgggtgcaggtggaagaatgcaagtgtctcctccctccaagaagtctgaaaccgacaccatcaagcgcgtaccctgcgagacaccgcccttcactgtcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32656 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32657 - DNA, 342 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32658 - DNA, 319 bp, Artificial
  Mutation in BnaC.FAD2.a introduced by TALE nuclease pair BnFAD2_T03
caggatccatgggtgcaggtggaagaatgcaagtctctcctcccttcagctcccccgaaaccaaaaccctcaaacgcgtcccctgcgagacaccacccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32659 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 32660 - DNA, 348 bp, Artificial
  Mutation in BnaC.FAD2.a introduced by TALE nuclease pair BnFAD2_T03
caggatccatgggtgcaggtggaagaatgcaagtctctcctccccccagctcccccggaaccaacaccctcaaacgcgtcccctgcgagacaccaccattcactcaacctcaagaaagcaatcccaccgcactgtttcaaacgctcgatccctcgctctttctcctacctcatctgggacatcatcatagcctcctgcttctactacgtcgcccccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 32661 - DNA, 344 bp, Artificial
  Mutation in BnaC.FAD2.a introduced by TALE nuclease pair BnFAD2_T03
caggatccatgggtgcaggtggaagaatgcaagtgcctcctccctccaagaagtctgaaaccgacaccatcaagcgcgtaccctgcgagacaccgcccttcagactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcccctggcctctctactgggcctgccaagggtgtgtcctaaccgacgtctgggtcatagcccacatgtgctgccaccgcgccttcaacgactac

SEQ ID NO: 32662 - DNA, 348 bp, Artificial
  Mutation in BnaC.FAD2.a introduced by TALE nuclease pair BnFAD2_T03
caggatccatgggtgcaggtgcaagaatgcaagtctctcctcactccagctccaccggaaccaacaccctcaaacgcgtcccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaacgctgcgtcctaacgggcctctgggtcatcgcccacgagtgcagccaccacgccttcagcgactac

SEQ ID NO: 32663 - DNA, 349 bp, Artificial
  Mutation in BnaC.FAD2.a introduced by TALE nuclease pair BnFAD2_T03
caggatccattggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32664 - DNA, 442 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgactgttgccggtgctgtgccaggcccacggcttgaccccggagcaggtggtggccatcgccagccacgatggcggcaacagccgctggacagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32665 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccacgggtgcgtcctaacgggcctctgggtcatcgcccacgaatgcggccaccacgccttcagcgactac

SEQ ID NO: 32666 - DNA, 421 bp, Artificial
  Mutation in BnaC.FAD2.a introduced by TALE nuclease pair BnFAD2_T03
caggatccatgggtgcaggtggaagaatgcaagtgtctcctccctccaagatgtctgaaaccgacaccaccaagcgcgtaccctgcgagacaccgcccttcactatttgatgcctggcagttccctactctcgccagcaataatggtggcaagcaggcgctggatacggtccagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32667 - DNA, 339 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgccctctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32668 - DNA, 343 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgccctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcctctgggtcatagcccacgagtgcggccaccacgccttcagcgactac

SEQ ID NO: 32669 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaaactcaagaaagcaatcccaccgcactgtttcaaacgctcgatccctcgctctttctcctacctcatctgggacatcatcatagcctcctgcttctactacgtcgccaccacttacttccctctcctcccacaccctctctcctacttcgcctggcctctctactgggcctgccaagggtgcgtcctaaccggcgtctgggtcatagcccacgagtgcggccaccacgccttcagcgactac

SEQ ID NO: 32670 - DNA, 348 bp, Artificial
  Mutation in BnaC.FAD2.a introduced by TALE nuclease pair BnFAD2_T03
caggatccatgggtgcaggtggaagaatgcaagtgtctcctccctccaacacgtctgaaaccgacaacatcaagcgcgtaccctgcgagacaccaccattcactcgcactcacgaaagcaatccaaccgcactgtttcgaacgcacgatccctcgctctgtctcctacctcatctgagacatcagcatcgcctcctgcttctactacgtcgccacctcttacttccctctcctccctctccctctctcctacttcgcctggcctctctactgggcctgccaagggtgcgtcctaaccggcgtctgggtcatcgcccacgaatgcggccaccacgccttcagcgactac

SEQ ID NO: 32671 - DNA, 348 bp, Artificial
  Mutation in BnaC.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccacctcgccttcatcgactac

SEQ ID NO: 32672 - DNA, 350 bp, Artificial
  Mutation in BnaC.FAD2.a introduced by TALE nuclease pair BnFAD2_T03
caggatccatgggtgcatgtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32673 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32674 - DNA, 342 bp, Artificial
  Mutation in BnaC.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacatcgcccttccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32675 - DNA, 341 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacctgcgtctgggtcatagcccacgagtgcggccaccacgccttcagcgactac

SEQ ID NO: 32676 - DNA, 341 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccgaactcaagaaagcaatctcaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgtgtcatagcccacgagtgcggccaccacgccttcagcgactac

SEQ ID NO: 32677 - DNA, 350 bp, Artificial
  Mutation in BnaC.FAD2.a introduced by TALE nuclease pair BnFAD2_T03
caggatccatgggtgcaggtcgaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32678 - DNA, 356 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32679 - DNA, 349 bp, Artificial
  Mutation in BnaC.FAD2.a introduced by TALE nuclease pair BnFAD2_T03
caggatccatgggtgcaggtagaagaatgcaagtctctcctccctccagctcccccggaaccaacaccctcacacgcgtcccctgcgagacaccaccattcactgagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 32680 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccaattacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 32681 - DNA, 324 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 32682 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttccctcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccgcgccttcagcgactac

SEQ ID NO: 32683 - DNA, 332 bp, Artificial
  Mutation in BnaC.FAD2.a introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 32684 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 32685 - DNA, 340 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtacggctgcggcgagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32686 - DNA, 349 bp, Artificial
  Mutation in BnaC.FAD2.a introduced by TALE nuclease pair BnFAD2_T03
caggatccatgggtgcaggtggaagaatgcaagtctctcctccctccagctccccgggaaccaacaccctcaaacgcgtcccctgcgagacaccacccttcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32687 - DNA, 350 bp, Artificial
  Mutation in BnaC.FAD2.a introduced by TALE nuclease pair BnFAD2_T03
caggatccatgggtgcaggtggaagaatgcaagtctctcctccctccaaaaagtctgaaaccgacaccatcaagcgcgtaccctgcgagacaccgcccttcactgtagaactcaagaaagcaatcccacctcactgcttcaaacgctccatccctcgctccttctcctacctcatctgcgacatcatcatagcctcctgcctctactacctctccacagcctacttccctctcctccctcaccctctcccctacctcgcctggcctctctactgggcctgccaagggtgcgtcctaacgggcctctgggtcatagcccacgagtgcggccaccacgccttcagcgactac

SEQ ID NO: 32688 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccctcaagcgcgtcccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32689 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtatcatcaagaaagcaatcccaccgcactgtttcaaacgctcgatccctcgctctttctcctacctcatctgggacatcatcatagcctcctgcttctactacgccgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32690 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccgtcgtctgggtcatagcccacgagtgcggccaccacgccttcagcgactac

SEQ ID NO: 32691 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32692 - DNA, 350 bp, Artificial
  Mutation in BnaC.FAD2.a introduced by TALE nuclease pair BnFAD2_T03
caggatccatgggtgcaggtggaagaatgcaagtctatcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32693 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccacaacgccttcagcgactac

SEQ ID NO: 32694 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctctatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32695 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactgtttcaaacgctcgatccctcgctctttcttctacctcatctgggacatcatcatagcctcctgcttctactacgtcgccaccacttacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 32696 - DNA, 354 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagtccacgagtgcggccaccacgccttcagcgactac

SEQ ID NO: 32697 - DNA, 344 bp, Artificial
  Mutation in BnaC.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32698 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgactcaagaaagcaatcccaccgcactgtttcaaactctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcattgcccacaagtgcggcctccacgccatcagcaactac

SEQ ID NO: 32699 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacaagaaagcaatcccaccgcactgtttcaaacgctcgatccctcgctctttctcctacctcatcttggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32700 - DNA, 334 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtatcccaccgcactgtttcaaacgctcgatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 32701 - DNA, 333 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 32702 - DNA, 334 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtatcccaccgcactgtttcaaacgctcgatccctcgctctttctcctacctcatctgggacatcatcatagcctcctgcttctactacgtcgccaccacttacttccctctcctccctcaccctctcccttacctcgcctgacccctctactgggcctgccaaggctgcgtcctaacgggcctctgggtcatagcccacgagtgcggccaccacgccttcagcgactac

SEQ ID NO: 32703 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgcaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32704 - DNA, 305 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 32705 - DNA, 334 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 32706 - DNA, 376 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttaagcgcggcgggtgcgggggttacgcgcataagtgaagggcggtttaacaatcccaccgcactgtttcaaacgcccgatccctcgctctttctcctacctcatctgggacatcatcatagcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 32707 - DNA, 359 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgtctccagcgccagaactcaagaaagcaatcccaccgcactgtttcacacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32708 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 32709 - DNA, 347 bp, Artificial
  Mutation in BnaC.FAD2.a introduced by TALE nuclease pair BnFAD2_T03
caggatccatgggtgcaggtagaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 32710 - DNA, 334 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 32711 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 32712 - DNA, 339 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgaactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 32713 - DNA, 306 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccccgatttcggccaccacgccttcagcgactac

SEQ ID NO: 32714 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagacgcctgaaaccgacaccatcaaacgcgtcccctgcgagacaccacccttcactgtagaactcaagaaagcaatcccaccgcactgcttcaaacgctcgatccctcgctctttctcctacctcatctgcgacatcatcctagcctcctgcttctactacctcgccaccacctacttccctctcctcccccaccctctctcctacctcgcctggcctctctactgggcctgccaagggtgcgtcctaacgggcgtctgggtcatagcccacgagtgcggccaccacgccttcagcgactac

SEQ ID NO: 32715 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccatcaaacgcgtcccctgcgagacaccacccttcactctgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32716 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgcacgatccctcgctctttctcctccctcatctgggacctcatcatagcctcctgcttctactacgacgcccccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32717 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaaggctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcccctggcccctctactgggcctgccaaggctgcgtcctaacgggcctctgggtcatcgcccacgaatgcggccaccacgccttcagcgactac

SEQ ID NO: 32718 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgctcaagaaagcaatcccaccgcactgcttcaaacgctcgatccctcgctccttctcctacctcctctgggacatcatcatagcctcctgcttctactacgtcgccaccgcttacttccctctcctcccccaccctctcccctacttcgcctggcctctctactgggcctgccaagggtgcgtcctaaccggcgtctgggtcatggcccacgagtgcggccaccacgccttcagcgactac

SEQ ID NO: 32719 - DNA, 369 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctctaccacctctccacagcctacttccctcccccttacctcgcctgacccctctactgggcctgccaaggctgcgtcctaacgggcctctgggtcatagcccacgagtgcggccaccacgccttcagcgactac

SEQ ID NO: 32720 - DNA, 407 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcggacttcgctgctacccaaggttgccgggtgacgcacaccgtggaaacggatgaaggagaactcaagaaagcaatcccaccgcactgtttcaaacgctcgatccctcgctctttctcctacctcatctgggacatcatcatagcctcctgcttctactacgtcgccaccccttacttccctctcctccctcaccccctctcctacttcgcctggcctctctactgggcctgccaagggtgcgtcctaaccggcgtctgggtcatagcccacgagtgcggccaccacgccttagcgactac

SEQ ID NO: 32721 - DNA, 421 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgtgcaccggcaacagccgctggaccgtctccagcgcctgcttgccgccatcgtggctggcgatggccaccacctgaactcaagaaagcaatcccaccgcactgtttcaaacgctcgatccctcgctctttctcctacctcatctgggacatcatcatagcctcctgcttctacgacgtcgccaccacttacttccctctcctccctcaccctctcccttacctcgcctgacccctctactgggcctgccaaggctgcgtcctaacgggcctctgggtcatagcccacgagtgcggccaccacgccttcagcgactac

SEQ ID NO: 32722 - DNA, 346 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32723 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcacagaactcaagaaagcaatcccaccgcactgtttcaaacgctcgatccctcgctctttctcctacctcatctgggacatcatcatagcctcctgcttctactacgtcgccaccacttacttccatctcctccctcaccctctctcctacttcgcctggcctctctactgggcctgccaagggtgcgtcctaaccggcgtctgggtcatagcccacgagtgcggccaccacgccttcagcgactac

SEQ ID NO: 32724 - DNA, 349 bp, Artificial
  Mutation in BnaC.FAD2.a introduced by TALE nuclease pair BnFAD2_T03
caggatccatgggtgcaggtggaagaatgcaagtgtctcctccctccagctcccccggaaccaacaccctcaaacgcgtcccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32725 - DNA, 349 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtatcatcaagaaagcaatcccaccgcactgtttcaaacgctcgatccctcgctctttctcctacctcatctgggacatcatcatagcctcctggttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32726 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgtgtcctaaccggcgtctgggtcatagcccacgagtgcggccaccacgccttcagcgactac

SEQ ID NO: 32727 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcgaacgcgtcccctgcgagacaccaccattcactcagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcggggtcatagcccacgagtgcggccaccacgccttcagcgactac

SEQ ID NO: 32728 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatggcctcctgcttctactacgtcgccaccacttacttccctctcctccctcaccctctctcctccttcgcctggcctctctactgggcctgccaagggtgcgtcctaaccggcgtctgggtcatagcccacgagtgcggccaccacgccttcagcgactac

SEQ ID NO: 32729 - DNA, 434 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcccagcaggtggtggccatcgccagcaatggcggtggcaagcaggcgctggagacggtccagcggctgttgccggtgctgggccagaactcaagaaagcaatcccaccgcactgtttcaaacgctcgatccctcgctctttctcctacctcatctgggacatcatcatagcctcctgcttctactacgtcgccaccacttacttccctctcctccctcacccgctctcctacttcgcctggcctctctactgggcctgccaagggtgcgtcctaaccggcgtctgggtcatagcccacgagtgcggccaccacgccttcagcgactac

SEQ ID NO: 32730 - DNA, 417 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttgtccggccacttcaagggcaactacaaggcccagctgaccaggctgaaccacatcaccaactgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32731 - DNA, 334 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccacctcgccttcagcgactac

SEQ ID NO: 32732 - DNA, 347 bp, Artificial
  Mutation in BnaC.FAD2.a introduced by TALE nuclease pair BnFAD2_T03
caggatccatgggtgcaggtgaaagaatgcaagtctctcctccctccagctcccccgaaaccaaaaccctcaaacgcgtcccctgcgagacaccacccttcactcgcctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32733 - DNA, 464 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaatgtcattgcgctgccattctccaaattgcagttcgcgcttagctggataacgccacggaatgatgtcgtcgtgcacaacaatggtgacttctacagcgcggagaatctcgctctctccaggggaagccgaactcaagaaatcaatcccaccgcactgtttcaaacgctcgatccctcgctctttctcctacctcatctgggacatcatcatagcctcctgcttctactacgtcgccaccacttacttccctctcccttacctcgcctgacccctctactgggcctgccaaggctgcgtcctaacgggcctctgggtcatagcccacgagtgcggccaccacgccttcagcgactac

SEQ ID NO: 32734 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32735 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagttcggccaccacgccttcagcgactac

SEQ ID NO: 32736 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaggcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggcttcgtcctaacgggcctctgggtcatcgcccacgaatgcggccaccacgccttcagcgactac

SEQ ID NO: 32737 - DNA, 352 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32738 - DNA, 346 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgagtcctaaccggcgtctgggtcatagcccacgagtgcggccaccacgccttcagcgactac

SEQ ID NO: 32739 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaccgcgtcccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 32740 - DNA, 319 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccacccttcactgtttcaaacgctcgatccctcgctctttcttctacctcatctgggacatcatcatagcctcctgcttctactacgtcgccaccacttacttccctctcctccctcaccctctctcctacttcgcctggcctctttactgggcctgctaagggtgcgtcctaaccggcgtctgggtcatagcccacgagtgcggccaccacgccttcagcgactac

SEQ ID NO: 32741 - DNA, 406 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgccgtcgggcatcctggagccgcccgatttagagcttgacggggaaagccggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32742 - DNA, 347 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgacctcaagaaagcaatcccaccgcactgtttcaaacgctcgatccctcgctctttctcctacctcatctcggacatcatcatagcctcctgcttctactacgtccccaccccttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 32743 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaaacaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctcccaaggctgcgtcctaacgggcctctgggtcatagcccacgagtgcggccaccacgccttcagcgactac

SEQ ID NO: 32744 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 32745 - DNA, 317 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32746 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 32747 - DNA, 335 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 32748 - DNA, 373 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacactgccaggcatcaaactaagcagaaggccatccgtcaaacgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32749 - DNA, 306 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32750 - DNA, 308 bp, Artificial
  Mutation in BnaC.FAD2.a introduced by TALE nuclease pair BnFAD2_T03
caggatccatgggtgcaggtgaaagaatgcaagtgtctcctcccttcaagaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgctgccaccacgccatcagcaactac

SEQ ID NO: 32751 - DNA, 277 bp, Artificial
  Mutation in BnaC.FAD2.a introduced by TALE nuclease pair BnFAD2_T03
caggatccatgggtgcaggcggaagaatgcaagtgtctcctccctccaagaagtctgaaaccgacaccatcaagcgcgtaccctgcgagacaccgcccttcactgtcgatcgagcgtttgaaacagtgcggtgggattgctttcttgagttctccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 32752 - DNA, 434 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcccagcaggtggtggccatcgccagcaatggcggtggcaagcaggcgctggagacggtccagcggctgttgccggtgctgtgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 32753 - DNA, 359 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgtctccagcgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagagtgcgtcctaaccggcgtctgggtcatagcccacgagtgcggccaccacgccttcagcaactac

SEQ ID NO: 32754 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcgaactcaagaaagcaatcccaccgcactgtttcaaacgctcgatccctcgctctttctcctacctcatctgggacatcatcatagcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 32755 - DNA, 287 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacacagcccttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 32756 - DNA, 350 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcttggtcatagcccacgagtgcggccaccacgccttcagcgactac

SEQ ID NO: 32757 - DNA, 346 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32758 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcacgcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32759 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcgctgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32760 - DNA, 348 bp, Artificial
  Mutation in BnaC.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32761 - DNA, 379 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggtcatagcattggatcggatcccgggcccgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32762 - DNA, 352 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtggagaactcaagaaagcaatcccaccacactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32763 - DNA, 339 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgactcaagaaagcaatcccaccgcactgtttcaaacgctcgatccctcgctctttctcctacctcctcttcgacatcatcatctcctcctcggctcctccctctaccacctctccacagcctactttcctctcccttacctcgcctgacccctctactgggcctgccaaggctgcgtcctaacgggcctctgggtcatagcccacgagtgcggccaccacgccttcagcgactac

SEQ ID NO: 32764 - DNA, 348 bp, Artificial
  Mutation in BnaC.FAD2.a introduced by TALE nuclease pair BnFAD2_T03
caggatccatgggtgcaggtgcaagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttcccgctcctccctcaccctctctcctacttcgcctggcctctctactgggcctgccaagggtgcgtcctaaccggcttctgggtcatagcccacgagtgtggccaccacgccttcagcgactac

SEQ ID NO: 32765 - DNA, 334 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtatcccaccgcactgtttcaaacgctcgatccctcgctctttctcctacctcatctgggacatcatcatagcctcctgcttctactacgtcgccaccactcacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32766 - DNA, 401 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgggccttgtagttgcccttgaagtggccggacacgaacaggaacttgaactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32767 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcgcctggcctctctactgggcctgccaagggtgcgtcctaaccggcgtctgggtcatagcccacgagtgcggccaccacgccttcagcgactac

SEQ ID NO: 32768 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32769 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctaactcaagaaagcaatcccaccgcactgtttcaaacgctcgatccctcgctctttctcctacctcatctgggacatcatcatagcctcctgcttctactacgtagccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32770 - DNA, 348 bp, Artificial
  Mutation in BnaC.FAD2.a introduced by TALE nuclease pair BnFAD2_T03
caggatccatgggtgcaggtggaagaatgcaagtctctcctccctccagctccaccggaaccaacaccctcaaacgcgtcccctgcgagacaccaccattcactctaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32771 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgtgtcctaaccggcgtctgggtcatagcccacgagtgcggcctccacgccttcagcgactac

SEQ ID NO: 32772 - DNA, 325 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtatagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32773 - DNA, 349 bp, Artificial
  Mutation in BnaC.FAD2.a introduced by TALE nuclease pair BnFAD2_T03
caggatccatgggtgcaggtagaagaatgcaagtctttcctccctcccgctcccccggaaccaacaccctcaaacgcgtcccctgcgagacaccaccattcacggagacctcaagaaagcaatcccaccgcactgtttcaaacgctcgctccctcgctctttctcctacctcatctgggacatcatcatagcctcctgcttctactacgtcgccaccacttacttccctctcctccctcaccctctctcatacttcgcctggcctctctactgggcctgccaagggtgcgtcctaaccggcgtctgggtcatagcccacgagtgcggctaccacgccttcagcgactac

SEQ ID NO: 32774 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatagcccacgagtgcggccaccacgccttcagcgactac

SEQ ID NO: 32775 - DNA, 401 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgggccttgtagttgcccttgaagtggccggacacgaacaggaacttgaactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32776 - DNA, 346 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccctcaagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32777 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccaccgcactgtttcaaacgctcgatccctcgctctttctcctacctcatctgggacatcatcatagcctcctgcttctactacgtcaccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32778 - DNA, 277 bp, Artificial
  Mutation in BnaC.FAD2.a introduced by TALE nuclease pair BnFAD2_T03
caggatccatgggtgcaggtggcagaatgcaagtctctcctccctccaagaagtctgaaaccgacaccatcaagcgcgtaccctgcgagacaccgcccttcactgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32779 - DNA, 316 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgagtgcggccaccacgccttcagcgactac

SEQ ID NO: 32780 - DNA, 337 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttagaactcaagaaagcaatcccaccgcactgtttcaaacgctcgatccctcgctctttctcctacctcatctgggacatcatcatagcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 32781 - DNA, 353 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagcaatggcggtggctggagaactcaagaaagcaatcccaccgccctgtttcaaacgctcgatcccccgctctttctcctacctcatctgggacatcatcatctcctcctgcttctactacgtcgccaccacttacttccctctcccttacctcgcctgacccctctactgggcctgccaaggctgcgtcctaacgggcctctgggtcatagcccacgagtgcggccaccacgccttcagcgactac

SEQ ID NO: 32782 - DNA, 348 bp, Artificial
  Mutation in BnaC.FAD2.a introduced by TALE nuclease pair BnFAD2_T03
caggatccatgggtgcaggcggaagaatgcaagtctctcctccctccagctcccccggaaccaacaccctcaaacgcgtcccctgcgagacaccaccattcactctaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 32783 - DNA, 342 bp, Artificial
  Mutation in BnaC.FAD2.a introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgcctgcagcgactac

SEQ ID NO: 32784 - DNA, 348 bp, Artificial
  Mutation in BnaC.FAD2.a introduced by TALE nuclease pair BnFAD2_T03
caggatccttgggtgcaggtggaagaatgcaagtctctcctccctccagctcccccggaaccaacaccctcaaacgcgtcccctgcgagacaccaccattcactctaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 32785 - DNA, 338 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaaaacaatcccaccgcactgtttcaaacgctcgatccctcgctctttctcctacctcatctgggacatcatcatagcctcctgcttctactacgtcgccaccacttacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 32786 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggccatagcccacgagtgcggccaccacgccttcagcgactac

SEQ ID NO: 32787 - DNA, 350 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32788 - DNA, 357 bp, Artificial
  Mutation in BnaC.FAD2.a introduced by TALE nuclease pair BnFAD2_T03
caggatccatgggtgcaggtcgaagaatgcaagtgtctcctccctccaagaagtctgaaaccgacaccatcaagcgcgtaccctgcgagacaccgcccttcactgtcggtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32789 - DNA, 312 bp, Artificial
  Mutation in BnaC.FAD2.a introduced by TALE nuclease pair BnFAD2_T03
caggatccatgggtgcaggtggcagaatgcaagtgtcccctccctccaagaagtctgaaaccgacaccatcaagcgcgtaccctgcgagacaccgcccttcactgtttcaaacgctcgacccctcgctctttctcctacctcatctgggacatcatcatctcctcctcggctcctccctctaccacctctccacagcctacttccctctcccttccctcgcctgacccctctactgggcctgccaaggctgcgtcctaacgggcctctgggtcatagcccacgagtgcggccaccacgccttcagcgactac

SEQ ID NO: 32790 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgagtaccatgcgagacaccgcccttcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 32791 - DNA, 287 bp, Artificial
  Mutation in BnaC.FAD2.a introduced by TALE nuclease pair BnFAD2_T03
caggatccatgggtgcaggtggatgaatgcaagtgtctcctccctccaagaagtctgaaaccgacaccatcaagcgcgtaccctgcgagacacagcccttctcctacctcatctgggacatcatcatagcctcctgcttctactacgtcgccaccatttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32792 - DNA, 343 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 32793 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaaacgcgtaccctgcgagacaccgcccttcactgtagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 32794 - DNA, 308 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 32795 - DNA, 350 bp, Artificial
  Mutation in BnaC.FAD2.a introduced by TALE nuclease pair BnFAD2_T03
caggatccatgggtgcaggtggaagaatgcaagtctctcctccctcccgctcccccgaaaccaaaaccctcaaacgcgtcccctgcgagacaccacccttcactctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32796 - DNA, 331 bp, Artificial
  Mutation in BnaC.FAD2.a introduced by TALE nuclease pair BnFAD2_T03
caggatccatgggtgcagggggaagaatgcaagtgtctcctccctccaagaagtctgaaaccgacaccatcaagcgcgtaccctccaaaaacacacaactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggccggccaaggctgcgtcctaacgggcctctgggtcatagcccacgagtgcggccaccacgccttcagcgactac

SEQ ID NO: 32797 - DNA, 403 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtctccagcggctgttgccgccatcgtggctggcgatggccaccacctgctccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32798 - DNA, 349 bp, Artificial
  Mutation in BnaC.FAD2.a introduced by TALE nuclease pair BnFAD2_T03
caggatccatggttgcaggtgcaagaatgcaagtctctcctccctccagctcccccggaaccaacaccctcaaacgcgtcccctgcgagacaccaccattcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32799 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32800 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 32801 - DNA, 352 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 32802 - DNA, 475 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctctccagcgcctgcttgccgccatcgtggctggcgatggccaccacctgctccggggtcaagccgtgggcctggcacagcaccggcaagcaggcgctggagacggtccagcggctgttgccgccagagacctcaagaaagcaatcccacctcgctgcttcaaacgctccatcccacgctctttctcctacctcatctgggacatcatcatagcctcctgcttctacttcgtcgccaccacttacttccctctcctccctcaccctctctcctacttcgcctggcctctctactgggccttccaagggtgcgtcctaaccggcgtcggggtcatagcccacgagtgcggccaccgcgccatcagcgactac

SEQ ID NO: 32803 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactctaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32804 - DNA, 410 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgtcgactcaagacgatagttaccggataaggcgcagcggtcgggctgaacggggggtcgaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32805 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 32806 - DNA, 349 bp, Artificial
  Mutation in BnaC.FAD2.a introduced by TALE nuclease pair BnFAD2_T03
caggatccatggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32807 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcctggcctctctactgggcctgccaagggtgcgtcctaacgggcctctgggtcatcgcccacgaatgcggccaccacgccttcagcgactac

SEQ ID NO: 32808 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 32809 - DNA, 356 bp, Artificial
  Mutation in BnaC.FAD2.a introduced by TALE nuclease pair BnFAD2_T03
caggatccatgggtgcaggtcgtagaatgcaagtgcatcctccctccaagaagtctgaaaccgacaccatcaagcgcgtaccctgcgagacaccgcccttcactgtcggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctcgctactgggcctgccaagggtgcgtcctaaccggcggcggggtcatagcccacgagtgctgccacctcgccttcagcgactac

SEQ ID NO: 32810 - DNA, 349 bp, Artificial
  Mutation in BnaC.FAD2.a introduced by TALE nuclease pair BnFAD2_T03
caggatccatgggtgcaggtggaagaatgcaagtgtctcctacctccaagaagtctgaaaccgacaccatcaagcgcgtaccctgcgagacaccgcccttcactgtcggcggagaactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 32811 - DNA, 347 bp, Artificial
  Mutation in BnaC.FAD2.a introduced by TALE nuclease pair BnFAD2_T03
caggatccatgggtgcagggggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccatcaccctctctcctacttcgcctggcctctctactgggcctgccaagggtgcgtcctaaccggcgtctgggtcatagcccacgagtgcggccaccacgccttcagcgactac

SEQ ID NO: 32812 - DNA, 403 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgaaccttcggtttgatcttctcctgttgctcggctatgtgccaggccatgctagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32813 - DNA, 341 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32814 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32815 - DNA, 350 bp, Artificial
  Mutation in BnaC.FAD2.a introduced by TALE nuclease pair BnFAD2_T03
caggatccatgggtgcaggtggaagaatgcaagtgtctcatccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32816 - DNA, 374 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaactccagaaacccgcggctgagtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 32817 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagccaacgagtgcggccaccacgccttcagcgactac

SEQ ID NO: 32818 - DNA, 277 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgggacatcatcatagcctcctgcttctactacgtcgccaccacttacttccctctcctcccccaccctctcccttacctcgcctggcccctctactgggcctgccaaggctgcgtcctaacgggcctcggggtcatagcccacgagtgcggccaccacgccttcagcgactac

SEQ ID NO: 32819 - DNA, 380 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcatctagatccaatgatcatgagcggagaattaaggagaactcaagaaagcaatcccaccgcactgtttcaaacgctccatccctcgctccttctcctacctcctcttcgacatcctcgtctcctcctccctctaccacctctccacagcctactgccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 32820 - DNA, 357 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacacacctcaagaaagcaatcccaccgcactgtttcaaacgctcgatccctcgctctttctcctacctcatctgggacatcatcatagcctcctgcttctactacgtcgccaccacttacttccctctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 32821 - DNA, 343 bp, Artificial
  Mutation in BnaC.FAD2.a introduced by TALE nuclease pair BnFAD2_T03
caggatccatgggtgcaggtggcagaatgcaagtgtgtcctccctccaagaagtctgaaaccgacaccatcaagcgcgtaccctgcgagacaccgcccgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtccgaaccggcgtctgggtcatagcccacgagtgcggccaccacgccatcagcgactac

SEQ ID NO: 32822 - DNA, 295 bp, Artificial
  Mutation in BnaC.FAD2.a introduced by TALE nuclease pair BnFAD2_T03
caggatccatgggtgcaggtggaagaatgcaagtctctcatccctccaggtagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 32823 - DNA, 350 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaacatcaagtgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32824 - DNA, 337 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgggagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 32825 - DNA, 435 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcatcctcacctcctccagggtcagggtgccggcctttggtggcaagcaggcgctggagacggtccagcggctgttgccggtgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgctgccaccacgccttcagcgactac

SEQ ID NO: 32826 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacaagaaagcaatcccaccgcactgtttcaaacgctcgatccctcgctctttctcctacctcatctgggacatcatcatagcctcctgcttctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 32827 - DNA, 324 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccgggtacgcgcttgatgggacatcatcatagcctcctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32828 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagggcggccaccacgccttcagcgactac

SEQ ID NO: 32829 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccattaagccacgatggcggcaagcaggcgctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctaggtcatagcccacgagtgcggccaccacgccttcagcgactac

SEQ ID NO: 32830 - DNA, 342 bp, Artificial
  Mutation in BnaC.FAD2.a introduced by TALE nuclease pair BnFAD2_T03
caggatccattggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagcgcggccaccacgccttcagcgactac

SEQ ID NO: 32831 - DNA, 359 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcggatcggaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32832 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaacccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctggggcatagcccacgagtgcggccaccacgccatcagcgactac

SEQ ID NO: 32833 - DNA, 354 bp, Artificial
  Mutation in BnaC.FAD2.a introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctcgggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32834 - DNA, 410 bp, Artificial
  Mutation in BnaC.FAD2.a introduced by TALE nuclease pair BnFAD2_T03
caggatccatgggtgcaggtggaagaatgcaagtctctcctccctccagctcccccggaaccgacaccatcaagcgcgtaccctgcgagacaccgcccttcactgtcggttcagcctggtcagctgggccttgtagttgcccttgaagtggccggacacgaacaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32835 - DNA, 352 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagagacctcaagaaagcaatcccaccgcactgtttcaaaccctcgatccctcgctctttctcctacctcatctgggacatcatcatagcctcctgcttctactacgtcgccaccacttacttccctctcctccatcaccctctctcctacttcgcctggcctctctactgggcctgccaaggctgcgtcctaacgggcctctgggtcatagcccacgagtgcggccaccacgccttcagcgactac

SEQ ID NO: 32836 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactgtttcaaacgctcgatccctcgctctttcttctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 32837 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaacgcaagaaagcaagcccaccgcactgtttcaaacactcgatccctcgctctttctcctacctcatctgcgccatcatcatagcctcctgcttctactacgtcgccaccactcacttccctctcccccctcaccctctctcctacttcccctggcctctctaccgggcctgccaagcctgcgtcctaacgggcctctgggtcatagcccccgagtgcggccaccacgccatcagcgactac

SEQ ID NO: 32838 - DNA, 346 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactacctcaagaaagcaatcccacatcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32839 - DNA, 351 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcagaactcaaaaaagcaatcccaccgcactgtttcaaacgctcgatccctcactctttctcctacctcatccatcacctcctcatagcctcctccttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32840 - DNA, 349 bp, Artificial
  Mutation in BnaC.FAD2.a introduced by TALE nuclease pair BnFAD2_T03
caggatccatgggtgcaggtgggagaatgcaagtgtctcctccctccaagaagtctgaaaccgacaccatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 32841 - DNA, 338 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaaaacaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 32842 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcttggtcatagcccacgagtgcggccaccacgccttcagcgactac

SEQ ID NO: 32843 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcacttaacctcaagaaagcaatcccaccgcactgcttcaaacgctcgatccctcgctctttctcctacctcatctgggacatcatcatatcctcctgcttctactacgtcgccaccacttacttccctctcctccctcaccctctctcctacttcgcctggcctctctactggggctgccaagggtgcggcctaaccggcgtctgggtcatagcccacgagggcggcccccacggcttcagcgacttac

SEQ ID NO: 32844 - DNA, 348 bp, Artificial
  Mutation in BnaC.FAD2.a introduced by TALE nuclease pair BnFAD2_T03
caggatccatgggtgcaggtagaagaatgcaagtctctcctcactccagctcccccgaaaccaaaaccctcaaacgcgtcccctgcgagacaccacccttcacaagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcgtcctccacgcctgcatcgactac

SEQ ID NO: 32845 - DNA, 351 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32846 - DNA, 342 bp, Artificial
  Mutation in BnaC.FAD2.a introduced by TALE nuclease pair BnFAD2_T03
caggatccatgggtgcaggtggaataatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32847 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaggcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32848 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32849 - DNA, 342 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32850 - DNA, 336 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatccaacctcactgcttcaaacgctccatcccacgctacttctcctcttcgacatcatcatctcctcctcggctcctccctctaccacctctccacagcctacttccctctcccttacctcgcctgacccctctactgggcctgccaagggtgcgtcctaaccggcgtctgggtcatagcccgcgaatgctgccaccacgccttcagcgactac

SEQ ID NO: 32851 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctcccctccctcaccctctctcctacttcgcctggcctctctactgggcctgccaagggtgcgtcctaaccggcgtctgggtcatagcccacgagtgcggccaccacgccttcagcgactac

SEQ ID NO: 32852 - DNA, 342 bp, Artificial
  Mutation in BnaC.FAD2.a introduced by TALE nuclease pair BnFAD2_T03
caggatccatgggtgcaggtcgaagaatgcaagtgtctcctccctccaagaagtctgaaaccgacaccatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggccgctgggtcatagcccacgagtgctgccaccacgccttcagcgactac

SEQ ID NO: 32853 - DNA, 350 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 32854 - DNA, 348 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgctactactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 32855 - DNA, 406 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttgggcctggcacagcaccggcaacagccgctggaccgtctccagcgcctgcttgcgagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32856 - DNA, 369 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacggtggtttgtttgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatagcccacgagtgcggccaccacgccttcagcgactac

SEQ ID NO: 32857 - DNA, 344 bp, Artificial
  Mutation in BnaC.FAD2.a introduced by TALE nuclease pair BnFAD2_T03
caggatccatgggtgcaggtggcagaatgcaagtgtctcctccccccaagaagtctgaaaccgacaccatcaagcgcgtaccctgcgagacaccgcccttcaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccagcacgccttcagcgactac

SEQ ID NO: 32858 - DNA, 409 bp, Artificial
  Mutation in BnaC.FAD2.a introduced by TALE nuclease pair BnFAD2_T03
caggatccatgggtgcaggtggaagaatgcaagtctatcctccctccagctcccccgaaaccaaaaccctcaaacgcgtcccctgcgagacaccgcccttcactgtcaggcccacggcttgaccccggagcaggtggtggccatcgccagcaatattggtggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32859 - DNA, 343 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32860 - DNA, 343 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccctcaaacgcgtcccctgcgagacaccaccattcactcgagacctcaagaaagcaatcccacctcactgcttcaaacgctccatcccacgctccttctcctcttcgacatcatcatagcctcctgcttctactacgtcgccaccacttacttccctctcctccctcaccctctctcctacttcgcctggcctctctactgggcctgccaagggtgcgtcctaacctgcgtctgggtcatagcccacgagtgcggccaccactccttcatcgactac

SEQ ID NO: 32861 - DNA, 340 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcctgcagcgactac

SEQ ID NO: 32862 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgtgcctctgggtcatagcccacgagtgcggccaccacgccttcagcgactac

SEQ ID NO: 32863 - DNA, 400 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttccaggcccacggcttgaccccccagcaggtggtggccatcgccagcaatggacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32864 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctacgagacaccacccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32865 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccccgcgagacaccgcccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32866 - DNA, 308 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatagcccacgagtgcggccaccacgccttcagcgactac

SEQ ID NO: 32867 - DNA, 350 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagggcggccaccacgccgtcagcgactac

SEQ ID NO: 32868 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 32869 - DNA, 326 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32870 - DNA, 350 bp, Artificial
  Mutation in BnaC.FAD2.a introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactctagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatagcccacgagtgcggccaccacgccttcagcgactac

SEQ ID NO: 32871 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacacctccctccaagtgtctcctccctcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32872 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgcctagggtgcgtcctaaccggcgtctggggcatagcccacgtgtgcggccaccgcgccatcagcgactac

SEQ ID NO: 32873 - DNA, 351 bp, Artificial
  Mutation in BnaC.FAD2.a introduced by TALE nuclease pair BnFAD2_T03
caggatccatgggtgcaggtggaacaatgcaagtatctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactggtcctgccaagggtgcgtcctaaccggcgtctgggtcatagcccacgagtgcggccaccacgccttcagcgactac

SEQ ID NO: 32874 - DNA, 340 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtacggctgcggcgagcggagaactcaagaaagcaatcccaccgcactgtttcaaacgctcgatccctcgctctttctcctacctcatctgggacatcatcatagcctcctgcttctactacgtagccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32875 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctggtacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32876 - DNA, 332 bp, Artificial
  Mutation in BnaC.FAD2.a introduced by TALE nuclease pair BnFAD2_T03
caggatccatgggtgcaggtggcagaatgcaagtgtctcctccctccaaaaagtctgaaaccgacaccatcaagcgcgtaccctgcgagacaccgcccttcactgtcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32877 - DNA, 394 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcgttcaaatccgctcccggcggatttgtcctactcaggtgaacgagacctcaagaaagcaatcccaccgcactgtttcaaacgctcgatccctcgctctttctcctacctcatctgggacatcatcatagcctcctgcttctactacgtcgccaccaattacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32878 - DNA, 334 bp, Artificial
  Mutation in BnaC.FAD2.a introduced by TALE nuclease pair BnFAD2_T03
caggatccatgggtgcaggtcgaagaatgcaagtgtctcctccctccaagaagtctgaaaccgacaccatcaagcgcgtaccctgcgagacaccgcccttcactgtatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32879 - DNA, 382 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacagccgctggaccgtctccagcgcctgtcggagaactcaagaaagcaatcccaccgcactgtttcaaacgctcgatccctcgctctttctcctaccccatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32880 - DNA, 350 bp, Artificial
  Mutation in BnaC.FAD2.a introduced by TALE nuclease pair BnFAD2_T03
caggatccatgggtgcaggtggcagaatgcaagtgtctactccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32881 - DNA, 414 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaggcgctggagacggtccagcggctgttgccggtgctgtgccaggcccacggcttgaccccggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 32882 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctggcacatcatcatagcctcctgcttctactacgtcgccaccacttacttccctctcctccctcaccctctctcctacctcgcctggcctctctactgggcctgccaagggtgcgtcctaaccggcgtctgggtcatcgcccacgagtgcggccaccacgccttcagcgactac

SEQ ID NO: 32883 - DNA, 347 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgaactcaagaaagaaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32884 - DNA, 342 bp, Artificial
  Mutation in BnaC.FAD2.a introduced by TALE nuclease pair BnFAD2_T03
caggatccatgggtgcaggtggcagaatgcaagtctctcctccctccagctcccccggaaccaacaccctcaaacgcgtaccctgcgagacaccgcccttaactcaagaaagcaatcccaccgcactgtttcaaacgctcgatccctcgctcttcctcctacctcatctgggacatcatcatagcctcctgcttctactacgtcgccaccacttacttccctctcctccctcgccctctctcctacttcgcctggcctctctactgggcctgccaagggggcgtccgaaccggcgtcggggtcatagcccacgagtgcggccaccacgccttcagcgactac

SEQ ID NO: 32885 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgggaactcaagaaagcaatcccaccgcactgtttcaaacgctcgatccctcgctctttctcctacctcatctgggacatcatcatagcctcctgcttctactacgtcgcccccacttacttccctctcctccctcaccctctctcctacttcgcctggcctctctactgggcctgccaagggtgcggcctaaccggcgtctgggtcatagcccacgagtgtggccaccacgccttcagcgactac

SEQ ID NO: 32886 - DNA, 348 bp, Artificial
  Mutation in BnaC.FAD2.a introduced by TALE nuclease pair BnFAD2_T03
caggatccatgggtgcaggtcgcagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgattgcggccaccacgccttcagcgactac

SEQ ID NO: 32887 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 32888 - DNA, 389 bp, Artificial
  Mutation in BnaC.FAD2.a introduced by TALE nuclease pair BnFAD2_T03
caggatccatgggtgcaggtggaagaatgcaagtctctcctcactccagctcccccggaaccaacaccctcaaacgcgtcccctgcgagacaccgcccttcactggtttgtttgccggatcaagagctaccaactctttttccgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32889 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgtgtcatagcccacgagtgcggccaccacgccttcagcgactac

SEQ ID NO: 32890 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32891 - DNA, 350 bp, Artificial
  Mutation in BnaC.FAD2.a introduced by TALE nuclease pair BnFAD2_T03
caggatccatgggtgcaggtggaagaatgcaattgtctcctccctccaaaaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgcctggcctctctactgggcctgccaagggtgcgtcctaaccggcgtctgggtcatagcccacgagtgcggccaccacgccttcagcgactac

SEQ ID NO: 32892 - DNA, 327 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttccccaccgcactgtttcaaacgctcgatccctcgctctttctcctacctcatctgtgacatcatcatagcctcctgcttctactacgtcgccaccacttacttccctctcctccctcaccctctctcctacttcgcctggcctctctactgggccggccaaggctgcgtcctaacgggcctctgggtcatagcccacgagtgcggccaccacgccatcagcgactac

SEQ ID NO: 32893 - DNA, 350 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 32894 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatcttggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 32895 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32896 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32897 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 32898 - DNA, 326 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32899 - DNA, 413 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcgggatgggatccgatccaatgaagacaatcgacatagtgactggatatgttgtgttttacagagaactcaagaaagcaatcccaccgcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32900 - DNA, 350 bp, Artificial
  Mutation in BnaC.FAD2.a introduced by TALE nuclease pair BnFAD2_T03
caggatccatgggtgcaggtggcagaatgcaagtggctcctccctccaagaagtctgaaaccgacaccatcaagcgcgtaccctgcgagacaccgcccttcactgaagaactcaagaaagcaatcccaccgcactgtttcaaacgctcgatccctcgctctttctcctacctcatctgggacatcatcatagcctcctgcttctactacgtcgccaccacttaccttcctctcctccctcaccctctctcctacttcgcctggcctctctactgggcgtgcctagggtgcgtcctaaccggcgtctggggcatatcccacgagtgcggcctccgcgccagcagcgactac

SEQ ID NO: 32901 - DNA, 350 bp, Artificial
  Mutation in BnaC.FAD2.a introduced by TALE nuclease pair BnFAD2_T03
caggatccatgggtgcaggcgaaagaatgcaagtgtctcctccctacaagaagtctgaaacctacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 32902 - DNA, 287 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32903 - DNA, 319 bp, Artificial
  Mutation in BnaC.FAD2.a introduced by TALE nuclease pair BnFAD2_T03
caggatccatgggtgcaggtggaagaatgcaagtgtctactccctccaagaagactgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccgagggtgcgtcctaaccggcgtctgggtcatagcccacgagtgcggccaccacgccttcagcgactac

SEQ ID NO: 32904 - DNA, 355 bp, Artificial
  Mutation in BnaC.FAD2.a introduced by TALE nuclease pair BnFAD2_T03
caggatccatgggtgcaggtggaagaatgcaagtgtctcctccctccagctcccccgaaaccaaaaccctcaaacgcgtaccctgcgagacaccgcccttcactgtcggggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32905 - DNA, 280 bp, Artificial
  Mutation in BnaC.FAD2.a introduced by TALE nuclease pair BnFAD2_T03
caggatccatgggtgcaggtggaagaatgcaagtgtctcctccctccaagaagactgaaaccgacaccatcaagcgcgtaccctgcgagacaccgcccttcactgtcgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32906 - DNA, 428 bp, Artificial
  Mutation in BnaC.FAD2.a introduced by TALE nuclease pair BnFAD2_T03
caggatccatgggtgcaggtgcaagaatgcaagtctctcctccctccagctcccccggaaccaacaccctcaaacgcgtcccctgcgagacaccaccattcactggcacagcaccggcaatagccgctggaccgtcaggatggccttctgcttagtttgatgcctggcagtttatggcgggcaggaacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32907 - DNA, 276 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgatcgagcgtttgaaacagtgcggtgggattgctttcttgagttctccctctcctccctcaccctctctcctacttcgcctggcctctctactgggcctgccaagggtgcgtcctaacgggcctctgggtcatcgcccacgaatgcggccaccacgccttcagcgctac

SEQ ID NO: 32908 - DNA, 338 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaacacaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32909 - DNA, 391 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacggtccagcggctgttgccggtgctgtgccaggcccacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32910 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 32911 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 32912 - DNA, 334 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtatcccaccgcactgtttcaaacgctcgatccctcgctctttctcctacctcatctgggacatcatcatagcctcctgcttctactacgtcgccaccacttacttccctctcctccctcacactctctcctacttcgcctggcctctctactgggcctgccaagggtgcgtcctaaccggcgtctgggtcatagcccacgagtgcggccaccacgccttcagcgactac

SEQ ID NO: 32913 - DNA, 277 bp, Artificial
  Mutation in BnaC.FAD2.a introduced by TALE nuclease pair BnFAD2_T03
caggatccatgggtgcaggtggaagaatgcaagtgtctcctccctccaagaagcctgaaaccgacaccatcaagcgcgtaccctgcgagacaccgcccttcactgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32914 - DNA, 319 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 32915 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcgtcgcctggcctctctacggggcctgccgggggggcgtcctaaccggcgtctgggtgatagcccacgagtgcggccacgacgccgtcagcgactac

SEQ ID NO: 32916 - DNA, 348 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaaccgcgtaccctgcgagccaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcttcctaaccggcgtctgggtcatagcccacgagtgcggccaccacgccttcagcgactac

SEQ ID NO: 32917 - DNA, 348 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgaccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgcccagggtgcgtcctaaccggcgtctgtgtcatagcccacgagtgcggccagcacgccctcagtgactac

SEQ ID NO: 32918 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagttcggccaccacgccttcagcgactac

SEQ ID NO: 32919 - DNA, 311 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtatagaactcaagaaagcaatcccaccgcactgtttcaaacgctcgatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 32920 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32921 - DNA, 349 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagagcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttacctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32922 - DNA, 350 bp, Artificial
  Mutation in BnaC.FAD2.a introduced by TALE nuclease pair BnFAD2_T03
caggatccatgggtgcaggtggaagaatgcaagtctctcctccctcaagctcccccgaaaccaaaaccctcaaacgcgtcccctgcgagacaccacccttcactcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32923 - DNA, 420 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttgccggtgctgtgccaggcccacggcttgaccccccagcaggtggtggccatcgccagcaatggcggtggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagtccacgagtgcggccaccacgcctgcagcgactac

SEQ ID NO: 32924 - DNA, 285 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccgggtacgcgcttgatgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32925 - DNA, 342 bp, Artificial
  Mutation in BnaC.FAD2.a introduced by TALE nuclease pair BnFAD2_T03
caggatccataggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32926 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagcctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32927 - DNA, 349 bp, Artificial
  Mutation in BnaC.FAD2.a introduced by TALE nuclease pair BnFAD2_T03
caggatccatgggtgcaggtggaagaatgcaagtctctcctccctcccgctcccccgaaaccaaaaccctcaaacgcgtcccctgcgagacaccacccttcactaagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32928 - DNA, 333 bp, Artificial
  Mutation in BnaC.FAD2.a introduced by TALE nuclease pair BnFAD2_T03
caggatccatgggtgcaggtggaagaatgcaagtgtctcctcactcccagaagtctgaaaccgacaccatcaagcgcgtaccctgcgagacaccgcccttcactgaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 32929 - DNA, 354 bp, Artificial
  Mutation in BnaC.FAD2.a introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactctcgggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaaccggcgtctgggtcatagcccacgagtgcggccaccacgccttcagcgactac

SEQ ID NO: 32930 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaactcaagaaagcaatcccaccgcactgtttcaaacgctcgatccctcgctctttctcctacctcatctgggacatcatcatagcctcctgcttctactacgtcgccaccacttactttcctctcctccctcaccctctctcctacttcgcctggcccctctactgggcctgccaaggctgcgtcctaacgggcctctgggtcatcgcccacgagtgcggccaccacgccttcagcgactac

SEQ ID NO: 32931 - DNA, 357 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttttgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32932 - DNA, 380 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcgatggccaccacctgctgaggggtcaagcctaactcaagaaagcaatcccaccgcactgtttcaaacgctcgatccctcgctctttctcctacctcatctgggacatcatcatagcctcctgcttctactacgtcgccaccgcttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32933 - DNA, 350 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 32934 - DNA, 308 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32935 - DNA, 348 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctccttcctcaccctctctcctacttcgcctggcctctctactgggcctgccaagggtgcgtcctaaccggcgtctgggtcatagcccacgagtgcggccaccacgccttcagcgactac

SEQ ID NO: 32936 - DNA, 383 bp, Artificial
  Mutation in BnaC.FAD2.a introduced by TALE nuclease pair BnFAD2_T03
caggatccatgggtgcaggtggaagaatgcaagtctctactccctcccgctcccccggaaccaacaccctcaaacggtccagcggctgttgccggtgctgtgccaggcccacggcttgaccccggagcaggtggtggccagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32937 - DNA, 394 bp, Artificial
  Mutation in BnaC.FAD2.a introduced by TALE nuclease pair BnFAD2_T03
caggatccatgggtgcaggtggcagaatgcaagtgtctactccctccaagaagtctgaaaccgacaccatcaagcgcgtaccctgcgagacaccgcccttcactgtcaggcccacggcttgaccccggagcaggtggtggccatcgccagcaatattggtggcggagaactcaagaaagcaatcccaccgcactgtttcaaacgctcgatccctcgctctttctcctacctcatctgggacatcatcatggcctcctgcttctactacgtcgccaccacttacttccctcgcccttgcctcgcctggcccctctactgggcctgccaaggctgcgtcctaacgggcctctgggtcatagcccacgagtgcggccaccacgccttcagcgactac

SEQ ID NO: 32938 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctatactgggcctgccaaggctgcgtcctaacgggcctctgggtcatagcccacgagtgtggccaccacgccttcagcgactac

SEQ ID NO: 32939 - DNA, 351 bp, Artificial
  Mutation in BnaC.FAD2.a introduced by TALE nuclease pair BnFAD2_T03
caggatccatgggtgcaggtgccagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 32940 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32941 - DNA, 351 bp, Artificial
  Mutation in BnaC.FAD2.a introduced by TALE nuclease pair BnFAD2_T03
caggatccatgggtgcaggtggcagaatgcaagtgtctcctccctccaaaaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcggggtcatagcccacgagtgcggccaccacgccttcagcgactac

SEQ ID NO: 32942 - DNA, 317 bp, Artificial
  Mutation in BnaC.FAD2.a introduced by TALE nuclease pair BnFAD2_T03
caggatccatgggtgcaggtggaagaacgcaagtgtctcctccctccaagaagtctgaaaccgacaccatcaagcgcgtaccctgcgagacaccgcccttcactgtcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32943 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcgagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32944 - DNA, 364 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtccccacgcgtcccagcaatggcggtggcaagcaggcgctggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32945 - DNA, 418 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacctctgacttgagcgtcgatttttgtgatgctcgtcagggggggccatcgccagcaatggcggcggcaggccggcgctgggacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32946 - DNA, 347 bp, Artificial
  Mutation in BnaC.FAD2.a introduced by TALE nuclease pair BnFAD2_T03
caggatccatgggtgcagggggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctcccccaccctctctcctacttcgcctggcctctctactgggcctaccaagggtgcgtcctaaccggcgtctggttcatagcccacgagtgcggccaccacgccttcagcgactac

SEQ ID NO: 32947 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32948 - DNA, 345 bp, Artificial
  Mutation in BnaC.FAD2.a introduced by TALE nuclease pair BnFAD2_T03
caggatccatgggtgcaggtggaagaatgcaagtctctcctccctcccgctcccccgaaaccaaaaccctcaaacgcgtcccctgcgagacaccgcccttcactactcaagaaagcaatcccaccgcactgtttcaaacgctcgatccctcgctctttctcctacctcatctgggacatcatcatagcctcctgcttctactacatcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 32949 - DNA, 350 bp, Artificial
  Mutation in BnaC.FAD2.a introduced by TALE nuclease pair BnFAD2_T03
caggatccatgggtgcaggtggcagaatgcaagtgtctactccttccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtccgtcctaaccggcggctgggtcatagcccaccagtgcgtcctccacgcctgcagcgactac

SEQ ID NO: 32950 - DNA, 349 bp, Artificial
  Mutation in BnaC.FAD2.a introduced by TALE nuclease pair BnFAD2_T03
caggatccatgggtgcagggggaagaatgcaagtgtctcctccctccaagaagtctgaaaccgacaccatcaagcgcgtaccctgcgagacaccgcccttcactgtaaactcaagaaagcaatcccaccgcactatttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32951 - DNA, 410 bp, Artificial
  Mutation in BnaC.FAD2.a introduced by TALE nuclease pair BnFAD2_T03
caggatccatgggtgcaggtggaagaatgcaagtaactcctccctccagctcccccgaaaccaaaaccctcaaacgcgtcccctgcgagacaccgcccttcactgtcggttcagcctggtcagctgggccttgtagttgcccttgaagtggccggacacgaacaggagaactcaagaaagcaatcccaccgcactgtttcaaacgctcgatccctcgctctttctcctacctcatctgggacatcatcatagcctcccgcttctactacgtcgccaccacttacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 32952 - DNA, 347 bp, Artificial
  Mutation in BnaC.FAD2.a introduced by TALE nuclease pair BnFAD2_T03
caggatccatgggtgcaggtggcagaatgcaagtctctcctccctccagctcccccggaaccaacaccctcaaacgcgtcccctgcgagacaccacccttcactcacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32953 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctacctcatctgggccatcatcataccctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32954 - DNA, 352 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 32955 - DNA, 333 bp, Artificial
  Mutation in BnaC.FAD2.a introduced by TALE nuclease pair BnFAD2_T03
caggatccatgggtgcaggtggaagaatgcaagtgtctcctccctccagctcccccgaaaccaaaaccctcaaacgcgtcccctgcgagacaccacaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32956 - DNA, 386 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgccagccacgatggcggcaacagccgctggaccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32957 - DNA, 405 bp, Artificial
  Mutation in BnaC.FAD2.a introduced by TALE nuclease pair BnFAD2_T03
caggatccatgggtgcaggtgaaagaatgcaagtgtctactccctccaagaagtctgaaaccgacaccatcaagcgcgtaccctgcgagacaccgcccttcactgtcggcaacagccgctggaccgtctccagcgcctgcttgccaccattattgctggcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttcgcctggcctctctactgggcctgccaagggtgcgtcctaaccggcgtctgggtcatagcccacgagtgcggccaccacgccttcagcgactac

SEQ ID NO: 32958 - DNA, 324 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaaaacaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 32959 - DNA, 350 bp, Artificial
  Mutation in BnaC.FAD2.a introduced by TALE nuclease pair BnFAD2_T03
caggatccatgggtgcagctggaagaatgcaagtgtctcctacctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32960 - DNA, 346 bp, Artificial
  Mutation in BnaC.FAD2.a introduced by TALE nuclease pair BnFAD2_T03
caggatccatgggtgcaggtgggagaatgcaagtgtctcctccctcccagaagtctgaaaccgacaccatcaagcgcgtaccctgcgagacaccgcccttcactaactcaagaaagcaatcccaccgcactgtttcaaacgctcgatccctcgctctttctcctacctcatctgggacatcatcatagcctcctgcttctactgcgtcgccaccacttacttccctctcctccctcaccctctctcctacttcgcctggcctctctactgggcctgccaagggtgcgtcctaaccggcgtctgggtcatagcccacgagggcggccaccacgccttcagcgactac

SEQ ID NO: 32961 - DNA, 347 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgaactcaagaaagcaatcccaccgcactgtttcaaacgctcgatccctcgctctttctcctacatcatctgggacatcatcatagcctcctgcttctactacgtcgccaccacttacttccctatcctccctcaccctctctcctacttcgcctggcctctctactgggcctgccaagggtgcgtcctaaccggcgtctgggtcatagcccacgagtgcggccaccacgccttcagcgactac

SEQ ID NO: 32962 - DNA, 351 bp, Artificial
  Mutation in BnaC.FAD2.a introduced by TALE nuclease pair BnFAD2_T03
caggatccatgggtgcaggtggaagaatgcaagtgtctcctccatccaagaagcctgaaaccgacaccatcaagcgcgtaccctgcgagacaccgcccttcactgtcggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32963 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagactgaaacggacacaatcaagcgcgtaccctgcgagacaccgcccttcactgtagaactcaagaaagcaatcacaccgcactgtttcaaacgctcgatccctcgctctttctcctacctcatctgggacatcgtcatagcctcctgcttctactacggcgccaccacttacttccctctcctccctcaccctctctcctacttcgcctggcctctctactgggcctgccaagggcgcgtcctaaccggcgtctgggtcagagcccacgagtgcggccaccacgccttcagcgactac

SEQ ID NO: 32964 - DNA, 363 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactcgctcggtcgttcggctgcggcgagcggtagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 32965 - DNA, 350 bp, Artificial
  Mutation in BnaC.FAD2.a introduced by TALE nuclease pair BnFAD2_T03
caggatccatgggtgcaggtggcagaatgcaagtctctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 32966 - DNA, 346 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 32967 - DNA, 347 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32968 - DNA, 347 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcacagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcctctgggtcatagcccacgagtgcggccaccacgccttcagcgactac

SEQ ID NO: 32969 - DNA, 331 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaacaccctcaaacgcgtcccctgcgagacctcaagaaagcaatcccaccgcactgtttcaaacgctcgatccctcgctctttctcctacctcatctgggacatcatcatagcctcctgcttctactacgtcgccaccccttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32970 - DNA, 349 bp, Artificial
  Mutation in BnaC.FAD2.a introduced by TALE nuclease pair BnFAD2_T03
caggatccatgggtgcaggtgccagaatgcaagtgtctcctccctccaagaagtctgaaaccgacaccatcaagcgcataccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32971 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccatcagcgactac

SEQ ID NO: 32972 - DNA, 349 bp, Artificial
  Mutation in BnaC.FAD2.a introduced by TALE nuclease pair BnFAD2_T03
caggatccatgggtgcaggtggaagaatgcaagtgtctcctccctcccaaaagtctgaaaccgacaccatcaagcgcgtaccctgcgagacaccgcccttcactgagaactcaagaaagcaatcccaccgccctgtttcacacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32973 - DNA, 287 bp, Artificial
  Mutation in BnaC.FAD2.a introduced by TALE nuclease pair BnFAD2_T03
caggatccatgggtgcaggtggcagaatgcaagtgtcgcctccctccaagaagcctgaaaccgacaccatcaagcgcgtaccctgcgagacacagcccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgattgcggccaccacgccttcagcgactac

SEQ ID NO: 32974 - DNA, 346 bp, Artificial
  Mutation in BnaC.FAD2.a introduced by TALE nuclease pair BnFAD2_T03
caggatccatgggtgcaggttgaagaatgcaagtgtctcctccctccaagaagtctgaaaccgacaccatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32975 - DNA, 349 bp, Artificial
  Mutation in BnaC.FAD2.a introduced by TALE nuclease pair BnFAD2_T03
caggatccatgggtgcaggtggaagaatgcaagtatctcctccctccagctcccccgaaaccaaaaccctcaaacgcgtcccctgcgagacaccacccttcactcagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32976 - DNA, 295 bp, Artificial
  Mutation in BnaC.FAD2.a introduced by TALE nuclease pair BnFAD2_T03
caggatccatgggtgcaggtggaagaatgcaagtctctcatccctccaggtagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32977 - DNA, 338 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaacatcaagcgcgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32978 - DNA, 347 bp, Artificial
  Mutation in BnaC.FAD2.a introduced by TALE nuclease pair BnFAD2_T03
caggatccatgggtgcaggtgcaagaatgcaagtctctcctccctccagctcccccggaaccaacaccctcaaacgcgtcccctgcgagacaccaccattcactctcgggagacctcaagaaagcaatcccacctcactgcttcaaacgctccatcccacgctccttctcctcttcgacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32979 - DNA, 351 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctcgctactgggcctgccaagggtgcgtcctaaccggcgtctgggtcatagcccacgagtgcggccaccacgccttcagcgactac

SEQ ID NO: 32980 - DNA, 467 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgcggatggccttctgcttagtttgatgcctggcagtttatggcgggcaggggatggggtccggtccaataaagaccatcgacataatgactaaacgcggaacgcaatttttggaatggcagaactcaagaaagcaaacccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32981 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtccgaaaccgacaccatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32982 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32983 - DNA, 371 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttttgacggggtcagtgccttaagtactcaagaaagcaatcccaccgcactgtttcaaacgctcgatccctcgctctttctcctacctcatctgggacataatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 32984 - DNA, 350 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagagcggccaccacgccttcagcgactac

SEQ ID NO: 32985 - DNA, 336 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 32986 - DNA, 342 bp, Artificial
  Mutation in BnaC.FAD2.a introduced by TALE nuclease pair BnFAD2_T03
caggatccatgggtgcaggtggaagaatgcaagtgtctcctccctcccagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32987 - DNA, 306 bp, Artificial
  Mutation in BnaC.FAD2.a introduced by TALE nuclease pair BnFAD2_T03
caggatccatgggtgcaggtggaagaatgcaagtctcacctcactccagctcccccgaaaccaaaaccctcaaacgcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32988 - DNA, 343 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32989 - DNA, 419 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttgtccagcggctgttgccggtgctgtgccaggcccacggcttgacccctcagcaggtggtggccatcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 32990 - DNA, 384 bp, Artificial
  Mutation in BnaC.FAD2.a introduced by TALE nuclease pair BnFAD2_T03
caggatccatgggtgcaggtggcagaatgcaagtggctcctccctccaaaaagtctgaaaccgacaccatcaagcgcgtaccctgcgagacaccgcccttcagactgagcctttcgttttatctgttgtttgtcggtgaacgctctcctgagtaggtcaaatccgctctgtttcaaacgctcgatccctcgctctttctcctacctcatctgggacatcatcatagcctcctgcttctactacgtcgccacctcttacttccctctcctccctcaccctctctcctactgcgcctggcctctctactgggcctgccaagggtgcggcctaaccggcgtctgggtcatagcccacgagtgcggccaccacgccttcagcgactac

SEQ ID NO: 32991 - DNA, 319 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32992 - DNA, 323 bp, Artificial
  Mutation in BnaC.FAD2.a introduced by TALE nuclease pair BnFAD2_T03
caggatccatgggtgcaggtggaagaatgcaagtctctcctccaccaacaccctcaaacgcgtcccctgcgagacaccaccattcactctcgggagacctcaagaaagcaatcccaccgcactgtttcaaacgctcgatccctcgctctttctcctacctcatctgggacatcatcatagcctcctgcttctactacgtcgccaccacttacttccctctcccttacctcgcctgacccctctactgggcctgccaaggctgcgtcctaacgggcctctgggtcatagcccacgagtgcggccaccacgccttcagcgactac

SEQ ID NO: 32993 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaacagacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 32994 - DNA, 370 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaatggcaagcaggcgctggagacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32995 - DNA, 384 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttccccggagcaggtggtggccatcgccagcaatattggtggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32996 - DNA, 349 bp, Artificial
  Mutation in BnaC.FAD2.a introduced by TALE nuclease pair BnFAD2_T03
caggatccatgggtacaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 32997 - DNA, 413 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggccatcgccagcaatggcggtggcaagcaggcgctggagacggtccagcggctgttgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 32998 - DNA, 350 bp, Artificial
  Mutation in BnaC.FAD2.a introduced by TALE nuclease pair BnFAD2_T03
caggatccatgggtgcaggtggcagaatgcaagtgtctcctccctccaagaagtctgaagccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32999 - DNA, 342 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33000 - DNA, 352 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 33001 - DNA, 308 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 33002 - DNA, 282 bp, Artificial
  Mutation in BnaC.FAD2.a introduced by TALE nuclease pair BnFAD2_T03
caggatccatgggtgcaggtggaagaatgcaagtctctagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccagcgtctgggtcatagcccacgagtgcggccaccacgccttcagcgactac

SEQ ID NO: 33003 - DNA, 377 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacctgcgtctgggtcatagcccacgagtgcggccaccacgccttcagcgactac

SEQ ID NO: 33004 - DNA, 435 bp, Artificial
  Mutation in BnaC.FAD2.a introduced by TALE nuclease pair BnFAD2_T03
caggatcatgggtgcaggtggaagaatgcaagtgtctcctccctccaagaagtctgaaaccgacaccatcaagcgcgtaccctgcgagacaccgcccttcactgtgggcttgaccccccagcaggtggtggccatcgccagcaataatggtggcaagcaggcgctggagacggtccagcggctgttgccggagaactcaagaaagcaatcccaccgcactgtttcaaacgctcgatccctcgctctttctcctacctcagctgggccatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 33005 - DNA, 352 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33006 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttaactcaagaaagcaatcccaccgcactgtttcaaacgctcgatccctcgctctttctcctacctcatctgggacatcatcatagcctcctgcttctactacgtcgccaccgcttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 33007 - DNA, 344 bp, Artificial
  Mutation in BnaC.FAD2.a introduced by TALE nuclease pair BnFAD2_T03
caggatccatggtgcaggtggaagaatgcaagtgtctcctccctccaagaagtctgaaaccgacaccatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33008 - DNA, 351 bp, Artificial
  Mutation in BnaC.FAD2.a introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33009 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33010 - DNA, 369 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtacggtggtttgtttgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33011 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 33012 - DNA, 404 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgccagccacgatggcggcaagcaggcgctggagacggtccagcggctgttgccggtgctgagacctcaagaaagcaatcccacctcactgcttcaaacgctccatcccacgctccttctcctcttcgacatcatcatagcctcctgcttctactacgtcgcccccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33013 - DNA, 348 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaacatccagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33014 - DNA, 401 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacggtccagcggctgttgccgccatcgtggctggcgatggccaccacctgctccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33015 - DNA, 342 bp, Artificial
  Mutation in BnaC.FAD2.a introduced by TALE nuclease pair BnFAD2_T03
caggatccatgggtgcaggtggaagaatgcaagtgtctcctccctccaaaaagcctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33016 - DNA, 349 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtaaactcaagaaagcaatcccaccgcactgtttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 33017 - DNA, 433 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcccagcaggtggtggccatcgccagcaatggcggtggcaagcaggcgctggagacggtccagcggctgttgccggggctgtgccagaactcaagaaagcaatcccaccgcactgtttcaaacgcccgatccctcgctctttctcctccctcatctgggacatcatcatagcctcctgcttctactacgtcgccaccccttacttccctctcctccctcaccctctctcctacttcgcctggcctctctactgggcctgccaagggtgcgtcctaaccggcgtctgggtcatagcccacgagtgcggccaccacgccttagcgactac

SEQ ID NO: 33018 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcaccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 33019 - DNA, 348 bp, Artificial
  Mutation in BnaC.FAD2.a introduced by TALE nuclease pair BnFAD2_T03
caggatccatgggtgcaggtggaagaatgcaagtgtctcctccctcccagaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33020 - DNA, 331 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccaccgcactgtttcaaacgctcgatccctcgctctttctcctacctcatctggggcatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 33021 - DNA, 277 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgggacatcatcatagcctcctgcttctactacgtcgccaccacttacttccctctcctccctcaccctctctcctacttcgcctggcctctctactgggcctgccaatggtgcgtcctaaccggcgtctgggtcatagcccacgagtgcggccaccacgccttcagcgactac

SEQ ID NO: 33022 - DNA, 350 bp, Artificial
  Mutation in BnaC.FAD2.a introduced by TALE nuclease pair BnFAD2_T03
caggatccatgcgtgcaggtggaagaatgcaagtgacccatccctccaagaagcctgaaaccgacaccatcaagcgcggaccctgcgagacaccgcccttcactgtagaactcaagaaagcaatccccccgcactgtttcaaacgctcgatccctcgctctttctcctacctcatctgggacatcatcatagcctcctgcttctactacgtcgccaccacttacttccctctcctccctcaccctctctcctacttcgcctggcctctctactggtccggccaagggtgcgtcctaaccggcgtctgggtcatagcccacgagtgcggccaccacgccttcagcgactac

SEQ ID NO: 33023 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcacgaactcaagaaagcaatcccaccgcactgtttcacacgctcgatccctcgctctttctcctacctcatctgggacatcatcatagcctcctgcttctactacgtcgccaccccttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33024 - DNA, 347 bp, Artificial
  Mutation in BnaC.FAD2.a introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33025 - DNA, 332 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcccttacctcgcctgacccctctactgggcctgccaaggctgcgtcctaacgggcctctgggtcatagcccacgagtgcggccaccacgccttcagcgactac

SEQ ID NO: 33026 - DNA, 277 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgggacatcatcatagcctactgcttctactacgtcgccaccacttacttccctctcctccctcaccatctctcctacttcgcctggcctctctactgggcctgccaagggtgcgtcctaaccggcgtctgggtcatagcccacgagtgcggccaccacgccttcagcgactac

SEQ ID NO: 33027 - DNA, 421 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactatttgatgcctggcagttccctactctcgccagcaataatggtggcaagcaggcgctggatacggtccagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33028 - DNA, 277 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgggacatcatcatagcctcctgcttctactacgtcgccaccacttacttccctctcctccctcaccctctctcctacttcgcctggcctctctactgggcctgccaagggtgcgccctaaccggcgtctgggtcatagcccacgagtgcggccaccacgccttcagcgactac

SEQ ID NO: 33029 - DNA, 403 bp, Artificial
  Mutation in BnaC.FAD2.a introduced by TALE nuclease pair BnFAD2_T03
caggatccatgggtgcaggtggcagaatgcaagtgtctcctccctccaagaagcctgaaaccgacaccatcaagcgcgtaccctgcgagacaccgcccttcactgtcgctgtgcctggcccacggcttgaccccccagcaggtggtggccatcgccagcaaaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 33030 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctaccccatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33031 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaactcaagaaagcagtcccacctcaccgtttcaaacgctcgatcccccgctctttctcctacctcatctgggacatcatcatagcctcctgcttctactacgtcgccaccacttacttccctctcctccctcaccctctctcctacttcgcctggcctctctactgggcctgccaggggtgcgtcctaacgggcgtctgggtcatcgcccacgagtgcggccaccacgccttcagcgactac

SEQ ID NO: 33032 - DNA, 277 bp, Artificial
  Mutation in BnaC.FAD2.a introduced by TALE nuclease pair BnFAD2_T03
caggatccattggtgcaggtggaagaatgcaagtgtctcctccctccaagaagtctgaaaccgacaccatcaagcgcgtaccctgcgagacaccgcccttcactgtcgatcgagcgtttgaaacagtgcggtgggattgctttcttgagttctccctctcctccctcaccctctctcctacttcgcctggcctctctactgggcctgccaagggtgcgtcctgaccggcgtctgggtcatagcccacgagtgcggccaccacgccttcagcgactac

SEQ ID NO: 33033 - DNA, 350 bp, Artificial
  Mutation in BnaC.FAD2.a introduced by TALE nuclease pair BnFAD2_T03
caggatccatgggtgcaggtggcagaatgcaagtgtctcctccatccagctcccccggaaccaacaccctcaaacgcgtcccctgcgagacaccaccattcactctagacctcaagaaaccaatcccaccgcaatgtttcaaccgctcgatccctcgctctttctcctacctcatctgggacatcatcatagcctcctgcttctactacgtcgccaccacttacttccctctcctccctcaccctctctcctacttcgcctggcccctctactgggcctgccaagggtgcgtcctaaccggcgtctgggtcatagcccacgagtgcggccaccacgccttcagcgactac

SEQ ID NO: 33034 - DNA, 348 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 33035 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 33036 - DNA, 456 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaccacctgctggggggtcaagccgtgggcctggcacagcaccggcaacagccgctggaccgtctccagcgcctgcttgccaccattattgctggcgatggccaccaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 33037 - DNA, 410 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgtcggttcagcccggtcagctgggccttgtagttgcccttgaagtggccggacacgaacaggagaactcaagaaagcaatcccaccgcactgtttcaaacgctcgatccctcgctctttctcctaccgcatctgggacatcatcatagccgcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccaacagcgactac

SEQ ID NO: 33038 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacacttcactctagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 33039 - DNA, 349 bp, Artificial
  Mutation in BnaC.FAD2.a introduced by TALE nuclease pair BnFAD2_T03
caggatccatgggtgcaggtggaagaatgcaagtgtctcctccctcccagaagactgaaaccgacaccatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgcccccacttacttccctctcctccctcaccctctctcctacttcgcctggcctctctactgggcctgccaatggtgcgtcctaaccggcgtctgggtcatagcccacgagtgcggccaccacgccttcagcgactac

SEQ ID NO: 33040 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacttggcctgccaagggtgcgtcctaaccggcgtctgggtcatagcccacgagtgcggccaccacgccttcagcgactac

SEQ ID NO: 33041 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 33042 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctaccgggcctgccaagggtgcgtcctaaccggcgtctgggtcatagcccacgagtgcggccaccacgccttcagcgactac

SEQ ID NO: 33043 - DNA, 349 bp, Artificial
  Mutation in BnaC.FAD2.a introduced by TALE nuclease pair BnFAD2_T03
caggatccatgggtgcaggtggaagaatgcaagtgtctcctgactacaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 33044 - DNA, 347 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgacctcaagaaagcaatcccacctcactgcttcaaacgctccatcccacgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33045 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagccgcctgcttctactacgtcgccaccacttacttccctctcctccctcaccctctctcctactccgccaggccactctcctggacctgccaagggtgcgtcctaaccggcgtctggtcatagcccacgagtgcggccaccacgccttcagcgactac

SEQ ID NO: 33046 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttcctctcctccctcaccctctctcctacttcgcctggcctctctactgggcctgccaagggtgcgtcctaacgggcctctgggtcatagcccacgagtgcggccaccacgccttcagcgactac

SEQ ID NO: 33047 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcgtctgggtcatagcccacgagtgcggccaccacgccttcagcgactac

SEQ ID NO: 33048 - DNA, 347 bp, Artificial
  Mutation in BnaC.FAD2.a introduced by TALE nuclease pair BnFAD2_T03
caggatccatgggtgcaggtggcagaatgcaagtgtctcctccctccaagaagtctaaaaccgacaccatcaagcgcgtaccctgcgagacaccgcccttcactgaactcaagaaagcaatcccaccgcactgtttcaaacgctcgatccctcgctctttctcctacctcatctgggccatcatcatagcctcctgcttctactacgtcgcccccacttacttccctctcctccctcaccctctctcctacttcgcctggcctctctactgggcctgccatggctgcgtcctaaccggcgtctgggtcatagcccacgagtgcggccaccacgccttcagcgactac

SEQ ID NO: 33049 - DNA, 314 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 33050 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcctggcccctctactgggcctgccaaggctgcgtcctaacgggcctctgggtcatcgcccacgaatgcggccaccacgccttcagcgactac

SEQ ID NO: 33051 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctacttggcctgccaaggctgcgtcctaacgggcctctgggtcatcgcccacgaatgcggccaccacgccttcagcgactac

SEQ ID NO: 33052 - DNA, 287 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacacagcccttctcctacctcatctgggacatcatcataacctcctgcttctactacgtcgccaccacttacttccctctcctccctcaccctctctccgacttcgcctggcctctctactgggcctgccaagggtgcgtcctaaccggcgtctgggtcatagcccacgagtgcggccaccacgccttcagcgactac

SEQ ID NO: 33053 - DNA, 326 bp, Artificial
  Mutation in BnaC.FAD2.a introduced by TALE nuclease pair BnFAD2_T03
caggatccatgggtgcaggtggaagaatgcaagtgtatactcactccaagaagtctgaaaccgacaccatcaagcgcgtaccctgcgagacaccgcccttcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 33054 - DNA, 344 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33055 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaaccggcgtctgggtcatagcccacgagtgcggccaccacgccttcggcgactac

SEQ ID NO: 33056 - DNA, 409 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaggcccacgacttgaccccggagcaggtggtggctatcgccagcaatattggtggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33057 - DNA, 421 bp, Artificial
  Mutation in BnaC.FAD2.a introduced by TALE nuclease pair BnFAD2_T03
caggatccatgggtgcaggtggaagaatgcaagtgtctcctccctccaagaagcctgaaaccgacaccatcaagcgcgtaccctgcgagacaccgcccttcactatttgatgcctggcagttccctactctcgccagcaataatggtggcaagcaggcgctggagacggtccagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33058 - DNA, 346 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33059 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcacgcgcgtaccctgcgagacaccgcccatcactactcaagaaagcactcccaccgcactgtttaaaccgctcgatccctcgctctttctcctacctcctctgggacatcatcatagcctcctgcttctactacgtcgccaccacttacttccctcgcctccctcaccctctctcctacttcgcctggcctctctactgggcctgccaattgtgcgtcctaacctgcgtctgggtcatagcccacgagggcggccaccactcctccagcgactac

SEQ ID NO: 33060 - DNA, 356 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaaacgcgtaccctgcgagacaccgcccttcactttgctccaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33061 - DNA, 277 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgatcgagcgtttgaaacagtgcggtgggattgctttcttgagttctccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 33062 - DNA, 409 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgttgcactgacgggtgccccgctcaacttgaccccccagcaggtggtggccatcgccagcaataatggtggcaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33063 - DNA, 349 bp, Artificial
  Mutation in BnaC.FAD2.a introduced by TALE nuclease pair BnFAD2_T03
caggatccatgggtgcaggtgacagaatgcaagtgtcaaattccttaaaaaagtctgaaaccgacaccataaagcgcgtaccctgcgtgacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccttccaagggtgcggccggaccggcgtgtgggtcataggccacgagtgctgccaccacgccatgagcaactac

SEQ ID NO: 33064 - DNA, 319 bp, Artificial
  Mutation in BnaC.FAD2.a introduced by TALE nuclease pair BnFAD2_T03
caggatccatgggtgcaggtggcagaatgcaagtggctcctccctccaaaaagtctgaaaccgacaccatcaagcgcgtaccctgcgagacaccgcccttcactgtttcaaacgctcgatccctcgctcttgctcctccctcatctggtacatcatcatagcctcctgcttctactacgtcgccaccacgtacttccctctcctccctcaccctctctcctacttcgcctggcctctctactgggcctgccaagggttcggcctaaccggcgtctgggtcatagcccacgagttcggccaccacgccttgagcgactac

SEQ ID NO: 33065 - DNA, 414 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaggcgctggagacggtccagcggctgttgccggtgctgtgccaggcccacggcttgaccccggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcctctgggtcatagcccacgagtgcggccaccacgccttcagcgactac

SEQ ID NO: 33066 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagcctgaaaccgacaccatcaagcgcgtaccctgcgagacaccgcccttcagactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33067 - DNA, 467 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcagcggatttgaactactcaggagagcgttcaccgacaaacaacagataaaacgaaaggctcagtcttcctaattgcgtaccgctagccaggaagagtttgtagaaacgcaaaaaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33068 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagcctgaaaccgacaccatcaagcgcgtaccctgcgagacaccgcccttcactgtactcaagaaagcaatcccaccgcactgtttcaaacgctcgatccctcgctctttctcctacctcacctgggacatcatcatagcctcctgcttctactacgtcgccaccacttacttccctctcctccctcaccctctctcctacttcgcctggcctctctactgggcctgccaagggtgcgtcctaaccggcctctgggtcatcgcccacgaatgcggccaccacgccttcagcgactac

SEQ ID NO: 33069 - DNA, 350 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgacta

SEQ ID NO: 33070 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgctgcgcctggcctctctactgggcctgccaagggtgcgtcctaaccggcgtctgggtcatagcccacgagtgcggccaccacgccttcagcgactac

SEQ ID NO: 33071 - DNA, 342 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33072 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 33073 - DNA, 402 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgaaaccatcaagcgcgtaccctgcgagacaccgcccttcactgtccagcgcctgcttgccgccatcgtggctggcgatggccaccacctgctccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33074 - DNA, 341 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaaagcaatcccaccacactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 33075 - DNA, 348 bp, Artificial
  Mutation in BnaC.FAD2.a introduced by TALE nuclease pair BnFAD2_T03
caggatccatgggtgcaggtgcaagaatgcaagtgtctcctcactccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 33076 - DNA, 350 bp, Artificial
  Mutation in BnaC.FAD2.a introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 33077 - DNA, 319 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgccctccactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33078 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaatggtgcgtcctaaccggcgtctgggtcatagcccacgagtgcggccaccacgccttcagcgactac

SEQ ID NO: 33079 - DNA, 350 bp, Artificial
  Mutation in BnaC.FAD2.a introduced by TALE nuclease pair BnFAD2_T03
caggatccatgggtgcaggtggcagaatgcaagtgtctactcactccaaaaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33080 - DNA, 356 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactttgctccaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33081 - DNA, 347 bp, Artificial
  Mutation in BnaC.FAD2.a introduced by TALE nuclease pair BnFAD2_T03
caggatccatgggtgcaggtggcagaatgcaagtgtttcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactcggcctgccaagggtgcgtcctaaccggcgtctgggtcatagcccacgagtgcggccaccacgccttcagcgactac

SEQ ID NO: 33082 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgtgcctgccaagggtgcgtcctaaccggcgtctgggtcatagcccacgagtgcggccaccacgccttcagcgactac

SEQ ID NO: 33083 - DNA, 350 bp, Artificial
  Mutation in BnaC.FAD2.a introduced by TALE nuclease pair BnFAD2_T03
caggatccatgggtgcaggtggaagaatgcaagtgtcccctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33084 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctcagcgactac

SEQ ID NO: 33085 - DNA, 341 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33086 - DNA, 333 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgagcccccgatttagagcttgacggggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccggccaagggtgcgtcctaaccggcgtctgggtcatagcccacgagtgcggccaccacgccttcagcgactac

SEQ ID NO: 33087 - DNA, 379 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactttcgggttccatagcgttaaggtttcatttagcgcctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33088 - DNA, 349 bp, Artificial
  Mutation in BnaC.FAD2.a introduced by TALE nuclease pair BnFAD2_T03
caggatccatgggtgcaggtggcagaatgcaagtgtctactcactccaagaagcctgaaaccgacaccatcaagcgcgtaccctgcgagacaccgcccttcactgtaaactcaagaaagcaatcccaccgcactgtttcaaccgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccagcacgccttcagcgactac

SEQ ID NO: 33089 - DNA, 349 bp, Artificial
  Mutation in BnaC.FAD2.a introduced by TALE nuclease pair BnFAD2_T03
caggatccatgggtgcaggtggaagaatgcaagtgtatcctccctccaagaagactgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctatccggcgtctgggtcatagcccacgagtgcggccaccacgccttcagcgactac

SEQ ID NO: 33090 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcggcctagccggcgtctgggtcatagcccacgagtgcggccaccacgccttcagcgactac

SEQ ID NO: 33091 - DNA, 341 bp, Artificial
  Mutation in BnaC.FAD2.a introduced by TALE nuclease pair BnFAD2_T03
caggatcatgggtgcaggtggaagaatgcaagtgtcccctcccttcaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 33092 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgagtaccctgcgagacaccgcccttcactgactcaagaaagcaatcccaccgcactgtttcaaacgctcgatccctcactctttctcctacctcatctgggacatcatcatagcctcctgcttctactacgtcgccaccacttacttccctttcctccctcaccctctctcctactacgcctgacctctctactgggcctgccaagggtgcgtcctaaccggcgtctgggtcatagcccacgagggcggccaccacaccttctgcgactac

SEQ ID NO: 33093 - DNA, 331 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggcgcgtcctaaccggcgtctgggtcatagcccacgagtgcggccaccacgccttcagcgactac

SEQ ID NO: 33094 - DNA, 355 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgattgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctttcagcgactac

SEQ ID NO: 33095 - DNA, 347 bp, Artificial
  Mutation in BnaC.FAD2.a introduced by TALE nuclease pair BnFAD2_T03
caggatccatgggtgcaggtggaagaatgcaagtctctactccctccagctcccccgaaaccaaaaccctcaaacgcgtcccctgcgagacaccacccttcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcggcctaaccggcgtctgggtcatagcccacgagtgcggccaccacgccttcagcgactac

SEQ ID NO: 33096 - DNA, 336 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcggcctaaccggcgtctgggtcatagcccaggagtgcggccaccacgccttcagcgactac

SEQ ID NO: 33097 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccatggctgcgtcctaaccggcgtctgggtcatagcccacgagtgcggccaccacgccttcagcgactac

SEQ ID NO: 33098 - DNA, 349 bp, Artificial
  Mutation in BnaC.FAD2.a introduced by TALE nuclease pair BnFAD2_T03
caggatccatgggtgcaggtggaagaatgcaagtgtctccaccctccaagaagtctgaaaccgacaccatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacgtacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33099 - DNA, 317 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctatgggtcatcgcccacgaatgcggccaccacgccttcagcgactac

SEQ ID NO: 33100 - DNA, 384 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccgtccagcggctgttgccggtgttgtgcctgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33101 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagccgacgagtgcggccaccacgccttcagcgactac

SEQ ID NO: 33102 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctactacttcgcctggcctctctactgggcctgccaagggtgcgtcctaaccggcgtctgggtcatagcccacgagtgcggccaccacgccttcagcgactac

SEQ ID NO: 33103 - DNA, 380 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggtcatagcattggatcggatcccgggcccgagcactcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 33104 - DNA, 279 bp, Artificial
  Mutation in BnaC.FAD2.a introduced by TALE nuclease pair BnFAD2_T03
caggatccatgggtgcaggtggaagaatgcaagtctctcctccctccagtctctccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33105 - DNA, 410 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggttcagcctggtcagctgggccttgtagttgcccttgaagtggccggacacgaacaggagaactcaagaaagcaatcccaccgcactgtttcaaacgctcgatccctcgctctttctcctacctcatctgggacatcatcatagcctcctgcttctactacggcgccaccacgtacttccctctccgccctcacccgctctcctgcttcgcctggcctctctactgggcctgccaagggtgcgtcctaaccggcgtcggggtcatagcccacgagtgcggccaccacgccttcagcgactac

SEQ ID NO: 33106 - DNA, 385 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgactccatcaagcgcgtaccctgcgagacaccgcccttcactgtcgggtcagggtgccggccttgatcatctcgccgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 33107 - DNA, 343 bp, Artificial
  Mutation in BnaC.FAD2.a introduced by TALE nuclease pair BnFAD2_T03
caggatccatgggtgcaggtggaagaatgcaagtgtctccacactccaagaagtctgaaaccgacaccatcaagcgcgtaccctgcgagacaccgcccttcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33108 - DNA, 342 bp, Artificial
  Mutation in BnaC.FAD2.a introduced by TALE nuclease pair BnFAD2_T03
caggatccatgggtgcaggtggaagaatgcaagtctctcccccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttctctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33109 - DNA, 340 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgttcggctgcggcgagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccttgcctctctactgggcctgccaagggtgcgtcctaaccggcgtctgggtcatagcccacgagtgcggccaccacgccttcagcgactac

SEQ ID NO: 33110 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacactgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33111 - DNA, 340 bp, Artificial
  Mutation in BnaC.FAD2.a introduced by TALE nuclease pair BnFAD2_T03
caggatccatgggtgcaggtggcagaatgcaagtgtctactccctccaagaagtctgaaaccgacaccatcaagcgcgtaccctgcgagacaccgccctactcaagaaagcaatcccaccgcactgtttcaaacgctcgatccctcgctctgtctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33112 - DNA, 417 bp, Artificial
  Mutation in BnaC.FAD2.a introduced by TALE nuclease pair BnFAD2_T03
caggatccatgggtgcaggtggaagaatgcaagtgtctcctccctccaagaagtctgaaactgacaccatcaagcgcgtaccctgcgagacaccgcccttcactgttgtccggccacttcaagggcaactacaaggcccagctgaccaggctgaaccacatcaccaactgcggagaactcaagaaagcaatcccaccgcactgtttcaaacgctcgatccctcgctctttctcctacctcatctgtgacatcatcataccctcctgcttctactacgtcgccaccacttacttccctctcctccctcaccctctctcctccttcgcctggcctctctactgggcctgccaatggtgcgtcctaacgggcctctgggtcatagcccacgagtgcggccaccacgccttcagcgactac

SEQ ID NO: 33113 - DNA, 370 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaatggcaagcaggcgctggagacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 33114 - DNA, 348 bp, Artificial
  Mutation in BnaC.FAD2.a introduced by TALE nuclease pair BnFAD2_T03
caggatccatgggtgcaggtggaagaatgcaagtgtcttctcccttccacaagtctgaacccgacacaatcaagcgcctaccctgcgagacaccgcccttcactgtaactcaagaaagcaatcccaccgcactgtttcaaacgctcgatccctctctctttctcctacctcatctgggacatcatcatagcctcctgcttctactacgtcgccaccacgtacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33115 - DNA, 350 bp, Artificial
  Mutation in BnaC.FAD2.a introduced by TALE nuclease pair BnFAD2_T03
caggatccatgggtgcaggtggaagaatgcaagtttctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacataatcatagcctcctgcttctactacgtcgccaccacttacttccctctcctccctcaccctctctcctacttcgcctggtctctctactgggcctgccaagggtgcgtcctaaccggcgtctgggtcatagcccacgagtgcggccaccacgccttcagcgactac

SEQ ID NO: 33116 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctgagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33117 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcctggcctctctactgggcctgccaagggtgcgccctaacgggcctctgggtcatcgcccacgaatgcggccaccacgccttcagcgactac

SEQ ID NO: 33118 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33119 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaagggtgcgtcctaaccggcgtctgggtcatagcccacgagtgcggccaccacgccttcagcgactac

SEQ ID NO: 33120 - DNA, 327 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33121 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactgaagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 33122 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagggcggccaccacgccttcagcgactac

SEQ ID NO: 33123 - DNA, 319 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgccctccactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33124 - DNA, 357 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctgacccctctactgggactgccaaggctgcgtcctaacgggcctctgggtcatagcccacgagtgcggccaccacgccttcagcgactac

SEQ ID NO: 33125 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaacctacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33126 - DNA, 351 bp, Artificial
  Mutation in BnaC.FAD2.a introduced by TALE nuclease pair BnFAD2_T03
caggatccatgggtgcaggtgcaagaatgcaagtgtctcctccctccaagaagactgaaaccgacaccatcaagcgcgtaccctgcgagacaccgcccttcactgtcagaactcaagaaagcaatcccaccgcactgtttcaaacgctcgatccctcgttctttctcctacctcatctgggacatcatcatagcctcctgcttctactacgtcgccaccacttacttccctctcctcccccaccctctcccttacctcccctggcccctctactgggcctgccaaggctgcgtcctaacgggcctctgggtcatagccgacgagtgcggccaccacgcctgcagcgactac

SEQ ID NO: 33127 - DNA, 347 bp, Artificial
  Mutation in BnaC.FAD2.a introduced by TALE nuclease pair BnFAD2_T03
caggatccatgggtgcaggtggaagaatgcaagtctctcctgcctccagctcccccgaaaccaaaaccctcaaacgcgtcccctgcgagacaccacccttcacagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33128 - DNA, 386 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgccagccacgatggcggcaacagccgctggaccggagaactcaagaaagcaatcccaccgcactgtttcaaacgctcgatccctcgctctttctcctacctcatctgggacatcatcatagcctcctgcttctactacgacgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33129 - DNA, 407 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggtccagcggctgttgccggtgctgggaagccgaagtttccaaaatgtcgttgatcaaacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33130 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagcctgaaaccgacaccatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33131 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagactgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33132 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagatagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 33133 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 33134 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 33135 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactgtaactcaagaaagcaatcccaccgcactgtttcaaacgctccatccctcgctctttctcctacctcatctgggacatcatcatcgcctcctgcttctcctacgtcgccaccacctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33136 - DNA, 350 bp, Artificial
  Mutation in BnaC.FAD2.a introduced by TALE nuclease pair BnFAD2_T03
caggatccatgggtgaaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctagcctctctactgggcctgccaagggtgcgtcctaaccggcgtctgggtcatagcccacgagtgcggccaccacgccttcagcgactac

SEQ ID NO: 33137 - DNA, 335 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggcggcgtcctaacgggcctctgggtcatagcccacgagtgcggccaccacgccttcagcgactac

SEQ ID NO: 33138 - DNA, 348 bp, Artificial
  Mutation in BnaC.FAD2.a introduced by TALE nuclease pair BnFAD2_T03
caggatccatgggtgcaggtggcagaatgcaagtgtctcctccctccaagaagcctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33139 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgtgtcctaaccggcgtctgggtcatagcccacgagtgcggccaccacgccttcagcgactac

SEQ ID NO: 33140 - DNA, 360 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccatcccacgctccttctcaagaaagcaatcccacctcactgtttcaaacgctctatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33141 - DNA, 309 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaacatcaaaccgacaacacccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33142 - DNA, 337 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgggagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 33143 - DNA, 350 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacgtacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33144 - DNA, 468 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccctcaagcgcgtaccctgcgagacaccgcccttcactgtcggattgcaaaacgtggcggcgtgaccgcagtggaggcagtgcatgcatggcgcaatgcactgacgggtgccccgctcaacttgaccccccagcaggtggtggccatcgccagcaccgagcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33145 - DNA, 350 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacaggcgtctgggtcatagcccacgagtgcggccaccacgccttcagcgactac

SEQ ID NO: 33146 - DNA, 404 bp, Artificial
  Mutation in BnaC.FAD2.a introduced by TALE nuclease pair BnFAD2_T03
caggatccatgggtgcaggtggaagaatgcaagtgtcaccacacaccaagaagtctgaaaccgacaccatcaagcgcgtaccctgcgagacaccgcccttcactgtcgtctccagcgcctgcttgccgccatcgtggctggcgatggccaccacctgctccggactcaagaaagcaatcccaccgcactgtttcaaacgctcgatcccccgctctttctcctacctcatctgggacatcatcatagcctcctgcttctactacgtcgccaccactgacttccctcccctcccccaccctctccctttcctcgcctggcccctctactgggcctgccaaggctgcggcctaacgggcctctgggtcatcgcccacgaatgcgtccaccacgccttcagcgactac

SEQ ID NO: 33147 - DNA, 371 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggtccagcggctgttgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 33148 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaaactcaagaaagcaatcccaccgcactgtttcaaacgctcgatccctcgctctttctcctacctcatctgggacatcatcatagcctcctggttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33149 - DNA, 333 bp, Artificial
  Mutation in BnaC.FAD2.a introduced by TALE nuclease pair BnFAD2_T03
caggatccatgggtgcaggtgcaagaatgcaagtgtctcctcactccaagaagtctgaaaccgacaccatcacgcgcgtaccctgcgagacaccgcccttcactgaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcctgcagcgactac

SEQ ID NO: 33150 - DNA, 349 bp, Artificial
  Mutation in BnaC.FAD2.a introduced by TALE nuclease pair BnFAD2_T03
caggatccatgggtgcaggtggaagaatgcaagtgtctactccctccagctcccccggaaccaacaccctcaaacgcgtcccctgcgagacaccaccattcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33151 - DNA, 347 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaatcgacaccatcaagcgcgtaccctgcgagacaccgcccttcactgaactcaagaaagcaatcccaccgcactgtttcaaacgctcgatccatcgctctttctcctacctcatctgggacatcatcatagcctcctgcttctactacgtcgccaccacttacttccctctcctccctcaccctctctcctacttcgcctggcctctctactgggcctgccaagggtgtgtcctaaccggcgtctgggtcatagcccacgagtgcggccaccacgccttcagcgactac

SEQ ID NO: 33152 - DNA, 347 bp, Artificial
  Mutation in BnaC.FAD2.a introduced by TALE nuclease pair BnFAD2_T03
caggatccatgggtgcaggtggcagaattcaagtttatactccctccaagaagtctgaaaccgacaccatcaagcgagtaccctgcgagacaccgcccttcactgttaccgcgaaagcaatcccaccgcactgtttcaaacgctcgatccctcgctctttctcctacctcatctgggacatcatcatagcctcctgcttctactacgtcgccacctcttacttccctctcctccctcaccctctctccttcttcgcctggcctctctactgggcctgccatgggtgcggcctaaccggcgtcggtgtcttagaccacgagtgcgtccaccacgccttcagcgactac

SEQ ID NO: 33153 - DNA, 352 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33154 - DNA, 345 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgctcaagaaagcaatcccaccgcactgttccaaccgctcgatccctcgctctttctcctacctcatctgggacatcatcatagcctcctgcttctactacgtcgccaccccttacttccctctcctccctcaccctctctcctacttcccctcgcctctctacggggcctgctaagggtgcggcttaaccggcgtctgggtcatagcccagaagtgcggcccccccgccttgagccactac

SEQ ID NO: 33155 - DNA, 321 bp, Artificial
  Mutation in BnaC.FAD2.a introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactgtttcaaacgctcgatccctcgctctttctcctccctcatctgggacatcatcatagcctcctgcttctcctacgtcgccaccacttacttccctctcctccctcaccctctctcccttacctcgcctgacccctctactgggcctgccaaggctgcgtcctaacgggcctctgggtcatagcccacgagtgcggccaccacgccttcagcgactac

SEQ ID NO: 33156 - DNA, 338 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcagaactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 33157 - DNA, 347 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 33158 - DNA, 347 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgaactcaagaaagcaatcccaccgcactgtttcaaacgctcgatccctcgctctttctcctacctcatctgggacatcctcatagcctcctgcttctactacgtcgccaccacttacttccctctcctccctcaccctctctcctacttcgcctggcctctctactgggcctgccaagggtgcgtcctaaccggcgtctgggtcatagcccacgagtgtggccaccacgccttcagcgactac

SEQ ID NO: 33159 - DNA, 411 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcggagcaggtggtgaccatcgccagcaatattggtggcaagcaggcgctggagacggtgcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 33160 - DNA, 283 bp, Artificial
  Mutation in BnaC.FAD2.a introduced by TALE nuclease pair BnFAD2_T03
caggatccatgggtgcaggtggaagaatgcaagtgtctactccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcggcctaaccggcgtctgggtcatagcccacgagtgcggccaccacgcctgcagcgactac

SEQ ID NO: 33161 - DNA, 396 bp, Artificial
  Mutation in BnaC.FAD2.a introduced by TALE nuclease pair BnFAD2_T03
caggatccatgggtgcaggtggaagaatgcaagtctctcctccctccaaaaagtctgaaaccgacaccatcaagcgcgtaccctgcgagacaccgcccttcactgtcggatcccggccttttgctggccttttgctcccatgttctttccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcttcgcctggcctctctactgggcctgccaagggtgcgtcctaaccggcgtctgggtcatagcccacgagggcggccaccacgccttcagcgactac

SEQ ID NO: 33162 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttcactctcctccctcaccctctctcctacttcgcctggcctctctactgggcctgccaagggtgcgtcctaaccggcgtctgggtcatagcccacgagtgcggccaccacgccttcagcgactac

SEQ ID NO: 33163 - DNA, 332 bp, Artificial
  Mutation in BnaC.FAD2.a introduced by TALE nuclease pair BnFAD2_T03
caggatccatgggtgcagctggaagaatgcaagtatctcctccctccaagaagactgaaaccgacaccatcaagcgcgtaccctgcgagacaccgcccttcactatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 33164 - DNA, 331 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaacaccctcaaacgcgtcccctgcgagacctcaagaaagcaatcccacctcactgcttcaaacgctcgatccctcgctctttctcctacctcatctgggacatcatcctagcctcctgcttctactacgtcgccaccacttacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 33165 - DNA, 345 bp, Artificial
  Mutation in BnaC.FAD2.a introduced by TALE nuclease pair BnFAD2_T03
caggatccatgggtgcaggtggtagaatgcaagtgtctcctcactccaagaagtctgaaaccgacaccatcaagcgcgtaccctgcgagacaccgcccttcacaactcaagaaagcaatcccaccgcactgtttcaaccgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 33166 - DNA, 346 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33167 - DNA, 371 bp, Artificial
  Mutation in BnaC.FAD2.a introduced by TALE nuclease pair BnFAD2_T03
caggatccatgggtgcaggtggaagaatgcaagtgtctactccctccaagaaccctgaaaccgacaccatcaagcgcgtaccctgcgagacaccgcccttcactgtcggtccagcggctgttgccggacaactcaagaaagcaatcccaccgcactgtttcaaacgctcgatccctagctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcggggtcatagcccacgagtgcggccaccacgccttcagcgactac

SEQ ID NO: 33168 - DNA, 283 bp, Artificial
  Mutation in BnaC.FAD2.a introduced by TALE nuclease pair BnFAD2_T03
caggatccatgggtgcaggtggaagaatgcaagtgtctcctccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaagggtgcgtcctaaccggcgtctgggtcatagcccacgagtgcggccaccacgccttcagcgactac

SEQ ID NO: 33169 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagatagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33170 - DNA, 359 bp, Artificial
  Mutation in BnaC.FAD2.a introduced by TALE nuclease pair BnFAD2_T03
caggatccatgggtgcaggtggaagaatgcaagtgtctcctccctccacgaagtctgaaaccgacaccatcaagcgcgtaccctgcgagacaccgcccttcacgtctccagcgccagaactcaagaaagcaatcccaccgcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33171 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33172 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 33173 - DNA, 277 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33174 - DNA, 349 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcggcctaaccggcgtctgggtcatagcccacgagtgcggccaccacgccttcagcgactac

SEQ ID NO: 33175 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcacgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33176 - DNA, 346 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33177 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccatcaaacgcgtcccctgcgagacaccaccattcactctagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33178 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 33179 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33180 - DNA, 277 bp, Artificial
  Mutation in BnaC.FAD2.a introduced by TALE nuclease pair BnFAD2_T03
caggatccatgggtgcaggtggaagaatgcaagtgtctactcactccaagaagtctgaaaccgacaccatcaagcgcgtaccctgcgagacaccgcccttcactgtcgatcgagcgtttgaaacagtgcggtgggattgctttcttgagttctccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 33181 - DNA, 343 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 33182 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagccacgatggcgccacccaggcgctggagaactcaagaaagcaatcccaccgcactgtttcaaacgctcgatccctcgctcttccccctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33183 - DNA, 333 bp, Artificial
  Mutation in BnaC.FAD2.a introduced by TALE nuclease pair BnFAD2_T03
caggatccatgggtgcaggtggaagaatgaaagtctctcctccctccagctcccccggaaccaacaccctcaaacgcgtcccctgcgagacacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccatgaatgcggccaccacgccttcagcgactac

SEQ ID NO: 33184 - DNA, 349 bp, Artificial
  Mutation in BnaC.FAD2.a introduced by TALE nuclease pair BnFAD2_T03
caggatccatgggtgcaggtggaagaatgcaagtgtatactccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactggtcctgccaagggtgcgtcctaaccggcgtctgggtcatagcccacgagtgcgtccaccacgccttcagcgactac

SEQ ID NO: 33185 - DNA, 368 bp, Artificial
  Mutation in BnaC.FAD2.a introduced by TALE nuclease pair BnFAD2_T03
caggatccatgggtgcagttggaagaatgcaagtgtctcctccctccaagaagtctgaaaccgacaccatcaagcgcgtaccctgcgagacaccgcccttcactgtagcaatggcggtggctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33186 - DNA, 405 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcaacagccgctggaccgtctccagcgcctgcttgccaccattattgctggcgagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 33187 - DNA, 437 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctatctccagcgcctgcttgccaccgccattgctggcgatggccaccacctgctggggggtcaagccgtgggcctggcacagcaccgggagacctcaagaaagcaatcccaccgcactgtttcaaacgctcgatccctcgctctttctcctacctcatctgcgacatcatcatagcctcctgcttctactacgtcgccaccacttacttccctctcctccctcaccctctctcctacttcgcctagcctctctactgggcctgccaagggtgcgtcctaaccggcgtctgggtcatagcccacgagtgcggccaccacgccttcagcgactac

SEQ ID NO: 33188 - DNA, 334 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33189 - DNA, 335 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 33190 - DNA, 349 bp, Artificial
  Mutation in BnaC.FAD2.a introduced by TALE nuclease pair BnFAD2_T03
caggatccatgggtgcaggtggaagaatgcaagtctctcctccctccaagaagactgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 33191 - DNA, 433 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggaatactgggcatttcgttttatctgttgtttgtcggtgaacgctctcctgagtaggacaaatccgccgggagcggatttgaacgttgtgagacctcaagaaagcaatcccacctcactgcttcaaacgctccatcccacgctccttctcctcttcgacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33192 - DNA, 349 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgcccccacttacttccctctcctccctcaccctctctcctacttcgcctggcctctctactgggcctgccaagggtgcgtcctaacctgcgtctgggtcatcgcccacgaaggcggccaccacgccttcagcgactac

SEQ ID NO: 33193 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggttgcgtcctaaccggcgtctgggtcatagcccacgagtgcggccaccacgccttcagcgactac

SEQ ID NO: 33194 - DNA, 349 bp, Artificial
  Mutation in BnaC.FAD2.a introduced by TALE nuclease pair BnFAD2_T03
caggatccatgggtgcaggtggaagaatgcaagggtctcctccctccaagaagcctgaaaccgacaccataaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33195 - DNA, 356 bp, Artificial
  Mutation in BnaC.FAD2.a introduced by TALE nuclease pair BnFAD2_T03
caggatccatgggtgcagggggaagaatgcaagtggctcctcccaccaagaaggctgaaaccgacaccatcaagcgcgtaccctgcgagacaccgcccttcactttgctccaagaactcaagaaagcaatcccaccgcactgtttcaaacgctcgatccctcgctctttctcctacctcatctgggacatcatcatagcctcctgctcctactacgtcgccaccacttacttccctctcctccctcaccctctctcctgcttcacctggcctctctactgggcctgccaagggtgcgtcctaaccggcgtctgggtcatagcccacgagtgcggccaccacgccatcagcgactac

SEQ ID NO: 33196 - DNA, 333 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctccatcccacgctccttctcctcttcgacatcatcatctcctcctcggctcctccctctaccacctctccacagcctacttccctctcccttacctcgtctgacccctctactgggcctgccaaggctgcgtcctaacgggcctctgggtcatagcccacgagtgcggccaccacgccttcagcgactac

SEQ ID NO: 33197 - DNA, 348 bp, Artificial
  Mutation in BnaC.FAD2.a introduced by TALE nuclease pair BnFAD2_T03
caggatccatgggtgcaggtggaagaatgcaagtgactcctccatccaagaagactgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33198 - DNA, 341 bp, Artificial
  Mutation in BnaC.FAD2.a introduced by TALE nuclease pair BnFAD2_T03
caggatccatgggtgcaggtggaagaatgcaagtctctcctctctccagctcccccggaaccaacaccctcaaacgcgtcccctgcgagacaccaccattcactctacctcaagaaagcaatcccacctcactgcttcaaacgctccatcccacgctccttctcctcttcgacatcatcatagcctcctgcttctactacgtcgccaccacttacttccctctcctccctcaccctctctcctacttcgcctggtctctctactgggcctgccaagggtgcgtcctaaccggcgtctgggtcatagcccacgagtgcggccaccacgccttcagcgactac

SEQ ID NO: 33199 - DNA, 347 bp, Artificial
  Mutation in BnaC.FAD2.a introduced by TALE nuclease pair BnFAD2_T03
caggatccatgggtgcaggtggaagaatgcaagtctcccctccatacagctcccccgaaaccaaaaccctccaacgcgtcccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcccctcgcctctctactgcgcctgccaagggtgcgtcctaaccggcgtctggggcatagcccacgagtgcggcctccacgccatctgcgactac

SEQ ID NO: 33200 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttactttcctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33201 - DNA, 363 bp, Artificial
  Mutation in BnaC.FAD2.a introduced by TALE nuclease pair BnFAD2_T03
caggatccatgggtgcaggtggaagaatgcaagtgtctactccctccaaaaagtctgaaaccgacaccatcaagcgcgtaccctgcgagacaccgcccttcactggaaaaactcttggaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33202 - DNA, 350 bp, Artificial
  Mutation in BnaC.FAD2.a introduced by TALE nuclease pair BnFAD2_T03
cgggatccatgggtgcaggtggaagaatgcaagtctctcctccctccagctcccccggaaccaacaccctcaaacgcgtcccctgcgagacaccaccattcactcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33203 - DNA, 325 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtatagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcgtctgggtcatagcccacgagtgcggccaccacgccttcagcgactac

SEQ ID NO: 33204 - DNA, 440 bp, Artificial
  Mutation in BnaC.FAD2.a introduced by TALE nuclease pair BnFAD2_T03
caggatcatgggtgcaggtggaagaatgtaagtctctcctctctccagctcccacggaaccaacaccctcaaacgcgtcccctgcgagacaccaccattcactcacagcaccggcaacagccgctggaccgtctccagcgcctgcttgccaccgccaagccgtgggcctggcacagcaccggcaacagccgctggacgacctcaagaaagcaatcccaccgcactgtttcaaacgctcgatccctcgctctttcgcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33205 - DNA, 345 bp, Artificial
  Mutation in BnaC.FAD2.a introduced by TALE nuclease pair BnFAD2_T03
caggatccatgggtgcagggggaagaatgcaagtgtcacctccctccaagaagtctgaaaccgacaccatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccgcgagtgcggccaccacgccttcagcgactac

SEQ ID NO: 33206 - DNA, 345 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33207 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33208 - DNA, 314 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 33209 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaattcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33210 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagcctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 33211 - DNA, 326 bp, Artificial
  Mutation in BnaC.FAD2.a introduced by TALE nuclease pair BnFAD2_T03
caggatccatgggtgcagggggaagaatgcaagtgtctcctccctccaagaagtctgaaaccgacaccatcaagcgcgtaccctgcgagacaccgcccttcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 33212 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcatacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33213 - DNA, 308 bp, Artificial
  Mutation in BnaC.FAD2.a introduced by TALE nuclease pair BnFAD2_T03
caggatccatgggtgcaggtggaagaatgcaagtgtctcctccctccaagaagactgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33214 - DNA, 351 bp, Artificial
  Mutation in BnaC.FAD2.a introduced by TALE nuclease pair BnFAD2_T03
caggatccatggggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33215 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 33216 - DNA, 352 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33217 - DNA, 349 bp, Artificial
  Mutation in BnaC.FAD2.a introduced by TALE nuclease pair BnFAD2_T03
caggatccaatgggtgcaggtggaagaatgcaagtctctcctccctccagctcccccggaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgtgcctctgggtcatcgcccacgaatgcggccaccacgccttcagcgactac

SEQ ID NO: 33218 - DNA, 357 bp, Artificial
  Mutation in BnaC.FAD2.a introduced by TALE nuclease pair BnFAD2_T03
caggatccatgggtgcaggtggaagaatgcaagtgtctcctccctccaagaagcctgaaaccgacaccctcaagcgcgtaccctgcgagacaccgcccttcactgtttttgttagaaatcaagaaagcactcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 33219 - DNA, 314 bp, Artificial
  Mutation in BnaC.FAD2.a introduced by TALE nuclease pair BnFAD2_T03
caggatccatgggtgcaggtggaagaatgcaagtgtctcacccctccaagaagtctgaaaccgacaccatcaaactcaagaaagcaatcccaccacactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcggggtcatagcccacgagtgcggccaccacgccatcagcgactac

SEQ ID NO: 33220 - DNA, 346 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttaaagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33221 - DNA, 351 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgccctactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 33222 - DNA, 343 bp, Artificial
  Mutation in BnaC.FAD2.a introduced by TALE nuclease pair BnFAD2_T03
caggatccatgggtgcaggcggaagaatgcaagtctctcctccctccagctcccccggaaccaacaccctcaaacgcgtaccctgcgagacaccgcccttcaactcaagaaagcaatcccaccgcactgtttcaaacgctcgatccctcgctctttctcctacctcatctgggacatcaccatagcctcctgcttctactacgtcgccaccacttacttccctctcctccctcaccctctctcctacttcgcctggcctctctactgggcctgccaaggctgcgtcctaacgggcgtctgggtcatagcccacgagtgcggccaccacgccttcagcgactac

SEQ ID NO: 33223 - DNA, 348 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcttcgcctggcctctctactgggcctgccaagggtgcgtcctaaccggcgtctgggtcatagcccacgagtgcggccaccacgccttcagcgactac

SEQ ID NO: 33224 - DNA, 348 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaacatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccatcagcgactac

SEQ ID NO: 33225 - DNA, 349 bp, Artificial
  Mutation in BnaC.FAD2.a introduced by TALE nuclease pair BnFAD2_T03
caggatccatgggtgcaggtggaagaatgcaagtgtctcctacctccaagaagtctgaaaccgacaacatcaagcgcgtaccctgcgagacaccgcccttcactcagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33226 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagcctgaaaccgacaccatcaagcgcgtaccctgcgagacaccgcccttcactgtagaactcaagaaagcaatcccaccgcactgtttcaaacgctcgatccctcgctctttctcctacctcatctcggacatcatcatagcctcctgcttctactacgtcgccaccacttacttccctctcctccctcaccctctctcctacttcgcctgacccctctactgggcctgccaaggctgcgtcctaacgggcctctgggtcatcgcccacgagtgcggccaccacgccttcagcgactac

SEQ ID NO: 33227 - DNA, 332 bp, Artificial
  Mutation in BnaC.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactatcccaccgcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33228 - DNA, 345 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 33229 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 33230 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagcctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 33231 - DNA, 319 bp, Artificial
  Mutation in BnaC.FAD2.a introduced by TALE nuclease pair BnFAD2_T03
caggatccatgggtgcaggtggaagaatgcaagtgtctcctccatccaagaagcctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33232 - DNA, 357 bp, Artificial
  Mutation in BnaC.FAD2.a introduced by TALE nuclease pair BnFAD2_T03
caggatccattggtgcaggtggaagaatgcaagtgtctcctccctccaagaagtctgaaaccgacaccatcaagcgcgtaccctgcgagacaccgcccttcactgtttttgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33233 - DNA, 280 bp, Artificial
  Mutation in BnaC.FAD2.a introduced by TALE nuclease pair BnFAD2_T03
caggatccatgagtgcaggtggaagaatgcaagtgtctcctcccaccaagaagtctgaaaccgacaccatcaagcgcgtaccctgcgagacaccgcccttcactgtcgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33234 - DNA, 349 bp, Artificial
  Mutation in BnaC.FAD2.a introduced by TALE nuclease pair BnFAD2_T03
caggatccatgggtgcaggtgcaagaatgcaagtgtctcctccctacaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcatcgactac

SEQ ID NO: 33235 - DNA, 411 bp, Artificial
  Mutation in BnaC.FAD2.a introduced by TALE nuclease pair BnFAD2_T03
caggatccatgggtgcaggtgaaagaatgcaagtctctcctccctccagctcccccggaaccaacaccctcaaacgcgtcccctgcgagacaccaccattcactctcgccagccacgatggcggcaagcaggcgctggagacggtccagcggctgttgccggtgctgagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33236 - DNA, 349 bp, Artificial
  Mutation in BnaC.FAD2.a introduced by TALE nuclease pair BnFAD2_T03
caggatccatgggtgcaggtcgaagaatgcaagtgtctcctccatccaagaagtctgaacccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33237 - DNA, 343 bp, Artificial
  Mutation in BnaC.FAD2.a introduced by TALE nuclease pair BnFAD2_T03
caggatccatgggtgcagggagaagaatgcaagtgtctcctccctccaagaagtctgaaaccgacaccatcaagcgcgtaccctgcgagacaccgcccttcactgtaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccggccaatggtgcgtcctaaccggcttctgggtcatagcccacgagtgcggccactgcgccatctgcgactac

SEQ ID NO: 33238 - DNA, 386 bp, Artificial
  Mutation in BnaC.FAD2.a introduced by TALE nuclease pair BnFAD2_T03
caggatccatgggtgcaggcggaagaatgcaagtctctcctccctccaagaagtctgaaaccgacaccatcaagcgcgtaccctgcgagacaccgcccttcactgtcgccagccacgatggcggcaacagccgctggaccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33239 - DNA, 351 bp, Artificial
  Mutation in BnaC.FAD2.a introduced by TALE nuclease pair BnFAD2_T03
caggatccatgggtgcaggtgcaagaatgcaagtgtatcctccctccaagaagcctgaaaccgacaccatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33240 - DNA, 349 bp, Artificial
  Mutation in BnaC.FAD2.a introduced by TALE nuclease pair BnFAD2_T03
caggatccatgggtgcaggtggaagaatgcaagtctctcatccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggcctccacgccttcagcgactac

SEQ ID NO: 33241 - DNA, 347 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33242 - DNA, 346 bp, Artificial
  Mutation in BnaC.FAD2.a introduced by TALE nuclease pair BnFAD2_T03
caggatccatgggtgcaggtggaagaatgcaagtgtctcctccatccaagaagcctgaaaccgacacaatccagcgagtaccctgcgagacaccgcccttcactaactcaagaaagcaatcccaccgcactgtttcaaacgctcgatccctcgctctttctcctacctcatctgggacatcatcatagcctcctgcttctactacgtcgccaccacttacttccctctcctccatcaccctctctcctacttcgcctggcctctctactgggcctgccaagggtgcgtcctaaccggcgtctgggtcatagcccacgagtgcggccacctcgccttcagcgactac

SEQ ID NO: 33243 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcggagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 33244 - DNA, 351 bp, Artificial
  Mutation in BnaC.FAD2.a introduced by TALE nuclease pair BnFAD2_T03
caggatccatgggtgcaggtggaagaatgcaagtgtcacctccctccaagaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgtcaagggtgcgtcctaaccggcgtctgggtcatagcccacgagtgcggccaccacgccttcagcgactac

SEQ ID NO: 33245 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagactgaaaccgacaccatcaagcgcgtaccctgcgagacaccgcccttcactagaactcaagaaagcaatcccaccgcactgtttcaaacgctcgatccctcgctctttctcctacctcatccgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccatcagcgactac

SEQ ID NO: 33246 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccaccgcactgtttcaaacgctcgatccctcgctctttctcctacctcacctgggccatcatcatagccccctgcttctaccacgtcgccaccgcctacttccctctcctccctcaccctctctcctacctcgcctggcctctctactgggcctgccaaggctgcgtcctaaccggcgtctgggtcatagcccacgagtgcggccaccacgccttcagcgactac

SEQ ID NO: 33247 - DNA, 349 bp, Artificial
  Mutation in BnaC.FAD2.a introduced by TALE nuclease pair BnFAD2_T03
caggatccatgggtgcaggtggaagaatgcaagtctctcctccctccaagaagcctgaaaccgacaccctcaaacgcgtaccctgcgagacaccgcccttcactaagatctaaagaaagaaatcccaccacactgattgaaacgctcgatccctccctctctctcctacctcacctggcacatcatcatagcctcctgcctctactacatcgccaccacttacttccctctcctccctcaccctctctcctacttcgcctggcctctctaccgggcctgccaaggcggcgtcctagcgggcctctgggtcatcgcccacgagtgcggccaccacgccttcagcgactac

SEQ ID NO: 33248 - DNA, 352 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacatcgcccttcactgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33249 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33250 - DNA, 343 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33251 - DNA, 342 bp, Artificial
  Mutation in BnaC.FAD2.a introduced by TALE nuclease pair BnFAD2_T03
caggatccatgggtgcaggtggaagaatgcaagtgtctcctccatccaagaagtctgaaaccgacaccatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33252 - DNA, 348 bp, Artificial
  Mutation in BnaC.FAD2.a introduced by TALE nuclease pair BnFAD2_T03
caggatccatgggtgcaggtggaagaatgcaagtgtctcccccctccaagaagtctgaaaccgacaccatcaagcgcgtaccctgcgagacaccgcccttcactagaactcaagaaagcaatcccacctcactgtttcaaacgctccatccctcgctctttctcctacctcatctgcgacatcatcatagcctcctccttctactacgtcgccaccgcctacttccctctcctccctcaccctctctcctacctcgcctggcctctctactgggcctgccaagggtgcgtcctaaccggcgtctgggtcatagcccacgagtgcggccaccacgccttcagcgactac

SEQ ID NO: 33253 - DNA, 347 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33254 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacggggcctgccaaggctgcgtcctaacgggcctctgggtcatagcccacgagtgaggccaccacgccatcagcgactac

SEQ ID NO: 33255 - DNA, 342 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcacacgagtgcggccaccacgccttcagcgactac

SEQ ID NO: 33256 - DNA, 394 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggacttcgctgctacccaaggttgccgggtgacgcacaccgtagaaacggatgaaggagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 33257 - DNA, 345 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaacagacaccatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33258 - DNA, 363 bp, Artificial
  Mutation in BnaC.FAD2.a introduced by TALE nuclease pair BnFAD2_T03
caggatccatgggtgcagggagaagaatgcaagtctctcctccctccagctcccccgaaaccaaaaccctcaaacgcgtcccctgcgagacaccacccttcactctcctttctttctggagacctcaagaaagcaatcccacctcactgcttcaaacgctcgatccctcgctctttctcctacctcatctgggacatcatcatagcctcctgcttctactacgtcgccacctcttacttccctctcctccctcgccctctctcctacttcgcctggcctctctactgggcctgccaagggtgcttcctaaccggcgtctgggtcatagcccacgagtgcggccaccacgccttcatcgactac

SEQ ID NO: 33259 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgcctggcctctctactgggcctgccaagggtgcgtcctaaccggcgtctgggtcatagcccacgagtgcggccaccacgccttcagcgactac

SEQ ID NO: 33260 - DNA, 349 bp, Artificial
  Mutation in BnaC.FAD2.a introduced by TALE nuclease pair BnFAD2_T03
caggatccatgggtgcaggtggaagaatgcaagtctctcatccctccagctcccccggaaccaacaccctcaaacgcgtcccctgcgagacaccaccattcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccggccaagggtgcgtcctaaccggcgtcggggtcatagcccacgagtgcggccaccacgccttcatcgactac

SEQ ID NO: 33261 - DNA, 345 bp, Artificial
  Mutation in BnaC.FAD2.a introduced by TALE nuclease pair BnFAD2_T03
caggatccatgggtgcaggtggaagaatgcaagtctctcctccctccagctcccccagaaccaacaccctcaaacgcgtcccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33262 - DNA, 342 bp, Artificial
  Mutation in BnaC.FAD2.a introduced by TALE nuclease pair BnFAD2_T03
caggatccatgggtgcaggtggaagaatgcaagtgtctcccccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcaccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33263 - DNA, 344 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccattaagccacgatggcggcaagcaggcgctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33264 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccttgcctctctactgggcctgccaagggtgcgtcctaaccggcgtctgggtcatagcccacgagtgcggccaccacgccttcagcgactac

SEQ ID NO: 33265 - DNA, 341 bp, Artificial
  Mutation in BnaC.FAD2.a introduced by TALE nuclease pair BnFAD2_T03
caggatccatgggtgcaggtggaagaatgcaagtgtgtcccccctccaagaagtctgaaaccgacaccatcaagcgcgtaccctgcgagacaccgcccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtacgtcctaaccggcgtctggctcatagcccacgagtgcggccaccacgccatcagcgactac

SEQ ID NO: 33266 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttcttctacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33267 - DNA, 406 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcggagccgcttgccgccattgctggcgatggccaccacctgctggggggtcaagccgtgggtagaactcaagaaagcaatcccaccgcactgtttcaaacgctcgatccctcgctctttctcctacctcatctgggacatcatcatagcctcatgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33268 - DNA, 341 bp, Artificial
  Mutation in BnaC.FAD2.a introduced by TALE nuclease pair BnFAD2_T03
caggatccatgggtgcaggtgcaagaatgcaagtgtctcctccctccaagaagcctgaaaccgacaccatcaagcgcgtaccctgcgagacaccgcccttcactgagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33269 - DNA, 349 bp, Artificial
  Mutation in BnaC.FAD2.a introduced by TALE nuclease pair BnFAD2_T03
caggatccatgggtgcaggtggaagaatgcaagtgtctcctccttccaagaagtctgaaaccgacaccatcaagcgcgtaccctgcgagacaccgcccttcactgtcaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 33270 - DNA, 350 bp, Artificial
  Mutation in BnaC.FAD2.a introduced by TALE nuclease pair BnFAD2_T03
caggatccatgggtgcaggtggaagaatgcaagtgtctcccccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 33271 - DNA, 280 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggacatcatcatagcctcctgcttctactacgtcgccaccacttacttccctctcctccctcaccctctctcctacttcgcctggcctctctactgggcctgccaagggtgcgtcctaaccgacgtctgggtcatagcccacgagtgcggccaccacgccttcagcgactac

SEQ ID NO: 33272 - DNA, 347 bp, Artificial
  Mutation in BnaC.FAD2.a introduced by TALE nuclease pair BnFAD2_T03
caggatccatgggtgcaggtcgaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33273 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagcctgaaaccgacaacatcaagcgcgtaccctgcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33274 - DNA, 350 bp, Artificial
  Mutation in BnaC.FAD2.a introduced by TALE nuclease pair BnFAD2_T03
caggatccatgggtgcaggtggaagaatgcaagtgtcacccccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgctgccaccacgccatcagcgactac

SEQ ID NO: 33275 - DNA, 317 bp, Artificial
  Mutation in BnaC.FAD2.a introduced by TALE nuclease pair BnFAD2_T03
caggatccatgggtgcaggtggaagaatgcaagtctcacatccctccaagaagtctgaaaccgacaccatcaagcgcgtaccctgcgagacaccgcccttcactgtcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33276 - DNA, 344 bp, Artificial
  Mutation in BnaC.FAD2.a introduced by TALE nuclease pair BnFAD2_T03
caggatccatgggtgcaggtggaagaatgcaagtgtcacctccctccaagaagtctgaaaccgacaccatcaagcgcgtaccctgcgagacaccgcccttcagactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33277 - DNA, 344 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcacactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgcgcctgccaagggtgcgtcctaaccggcgtctgggtcatagcccacgagtgcggccaccacgccttcagcgactac

SEQ ID NO: 33278 - DNA, 351 bp, Artificial
  Mutation in BnaC.FAD2.a introduced by TALE nuclease pair BnFAD2_T03
caggatccatgggtgcaggtggaagaatgcaagtctctcctccctccaaaaagtctgaaaccgacaccatcaagcgcgtaccctgcgagacaccgcccttcactgtagaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33279 - DNA, 318 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33280 - DNA, 342 bp, Artificial
  Mutation in BnaC.FAD2.a introduced by TALE nuclease pair BnFAD2_T03
caggatccatgggtgcagggggaagaattcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctagcctctctactgggcctgccaagggtgcgtccgaaccggcgtctgggacatagcccacgagtgctgccaccacgccatcagcgactac

SEQ ID NO: 33281 - DNA, 344 bp, Artificial
  Mutation in BnaC.FAD2.a introduced by TALE nuclease pair BnFAD2_T03
caggatccatgggtgcaggaggaagaatgcaagtgtctcctccctccaagaagtctgaaaccgacaacatcaagcgcgtaccctgcgagacaccgcccttcacactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccatcagcgactac

SEQ ID NO: 33282 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcttccctcaccctctctcctacttcgcctggcctctctactgggcctgccaagggtgcgtcctaaccggcgtctgggtcatagcccacgagtgcggccaccacgccttcagcgactac

SEQ ID NO: 33283 - DNA, 346 bp, Artificial
  Mutation in BnaC.FAD2.a introduced by TALE nuclease pair BnFAD2_T03
caggatccatgggtgcaggtggaagaatgcaagtctttcctccctcccgctcccccgaaaccaaaaccctcaaacgcgtcccctgcgagacaccacccttcactacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33284 - DNA, 380 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgatggccaccacctgctgaggggtcaagccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 33285 - DNA, 349 bp, Artificial
  Mutation in BnaC.FAD2.a introduced by TALE nuclease pair BnFAD2_T03
caggatccatgggtgcaggtggaagaatgcaagtgtctcctccctctaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 33286 - DNA, 342 bp, Artificial
  Mutation in BnaC.FAD2.a introduced by TALE nuclease pair BnFAD2_T03
caggatccatgggtgcaggtgcaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcccccggcctctctaccgggcctgccaggggtgcgtccaaaccgggctctgggtcatagcccacgagtgcggccaccacgccttcatcgactac

SEQ ID NO: 33287 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgcgcctgccaaggctgcgtcctaacgggcctctgggtcatcgcccacgaatgcggccaccacgccttcagcgactac

SEQ ID NO: 33288 - DNA, 413 bp, Artificial
  Mutation in BnaC.FAD2.a introduced by TALE nuclease pair BnFAD2_T03
caggatccatgggtgcaggcggaagaatgcaagtgtctcctccctccaagaagtctgaaaccgacaccatcaagcgcgtaccctgcgagacaccgcccttcactgtcggccatcgccagcaatggcggtggcaagcaggcgctggagacggtccagcggctgttgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33289 - DNA, 352 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgagaactcaagaaagcaatcccaccgcactgtctcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33290 - DNA, 316 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 33291 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgctcaagaaatcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33292 - DNA, 349 bp, Artificial
  Mutation in BnaC.FAD2.a introduced by TALE nuclease pair BnFAD2_T03
caggatccatgtgtgcaggtggaagaatgcaagtctctcctccctccagctcccccggaaccaacaccctcaaacgcgtcccctgcgagacaccaccattcactcgagacctcaagaaagcaatccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33293 - DNA, 348 bp, Artificial
  Mutation in BnaC.FAD2.a introduced by TALE nuclease pair BnFAD2_T03
caggatccatgggtgcaggtggaagaatgcaagtgtctcctccatccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33294 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33295 - DNA, 368 bp, Artificial
  Mutation in BnaC.FAD2.a introduced by TALE nuclease pair BnFAD2_T03
taggatccatgggtgcaggtggaagaatgcaagtgtctcctccctccaaaaagtctgaaaccgacaccatcaagcgcgtaccctgcgagacaccgcccttcactgtagcaatggcggtggctggagaactcaagaaagcaatcccaccgcccttcttcaaacgctccatccctcgctctttctcctacctcatctgggacatcatcatagcctcctgcttctcctacgtcgccacctcttacttccctctcctccctcaccctctctccttcttcgcctggcctctctactgggcctgccaagggtgcgtcctaaccggcgtctgggtcatagcccacgagtgcggccaccacgccttcagcgactac

SEQ ID NO: 33296 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacctcatcatagcctcctgcttctactacgtcgccaccacttacttccctctcctccctcaccctctctcctgcttcgcctggcctctctactgggcctgccaagggtgcgtccgaaccggcgtctgggtcatagcccacgagtgctgccaccacgccatcagcgactac

SEQ ID NO: 33297 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagcctgaaaccgacaccatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33298 - DNA, 277 bp, Artificial
  Mutation in BnaC.FAD2.a introduced by TALE nuclease pair BnFAD2_T03
caggatccatgggtgcaggtggaagaatgcaagtgactcctccctccaagaagactgaaaccgacaccatcaagcgcgtaccctgcgagacaccgcccttcactgtcgatcgagcgtttgaaacagtgcggtgggattgctttcttgagttctccctctcctccctcaccctctctcctacttcgcctggcctctctactgggcctgccaagggtgcgtcctaaccggcgtctgggtcatagcccacgagtgcggccgccacgccttcggcgactac

SEQ ID NO: 33299 - DNA, 347 bp, Artificial
  Mutation in BnaC.FAD2.a introduced by TALE nuclease pair BnFAD2_T03
caggatccatgtgtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33300 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagtagcccgaaaccgacaccctcaaacgcgtaccctgcgagacaccacccttcactctgaactcaagaaagcaatcccaccgcactgtttcaaacgctcgatccctcgctctttctcctacctcatctgggacatcatcatagcctcctgcttctaccacgtcgccaccgcttacttccctctcctccctcaccctctctcctacttcgcctggcctctctactgggcctgccaagggtgcgtcctaaccggcgtctgggtcatcgcccacgagtgcggccaccacgccttcagcgactac

SEQ ID NO: 33301 - DNA, 328 bp, Artificial
  Mutation in BnaC.FAD2.a introduced by TALE nuclease pair BnFAD2_T03
caggatccatgggtgcaggtggaagaatgcaagtgtctcatacctccaagaagtctgaaaccgacaccatcaagcgcgtaccctgcgagacaccgcccttcactcaagaaagcaatcccaccgcactgtttccaacgctccatcccacgctccttctcctcttcgacatcatcatcacctcctcggctcctccctctaccacctctccacaccctacttccctctcccttacctcgcctgacccctctactgggcctgccaaggctgcgtcctaacgggcctctgggtcatagcccacgagtgcggccaccacgccttcagcgactac

SEQ ID NO: 33302 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 33303 - DNA, 352 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33304 - DNA, 347 bp, Artificial
  Mutation in BnaC.FAD2.a introduced by TALE nuclease pair BnFAD2_T03
caggatccatgggtgcaggtcgaagaatgcaagtgtcccctccaccccagaagcctgaaaccgacaccatccagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgcctggcctctctactgggcctgccaagggtgcgtcctaaccggcgtctgggtcatagcccacgagtgcggccaccacgccttcagcgactac

SEQ ID NO: 33305 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33306 - DNA, 347 bp, Artificial
  Mutation in BnaC.FAD2.a introduced by TALE nuclease pair BnFAD2_T03
caggatccatgggtgcaggtggaagaatgcaagtgtatcctcccttcaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgcctagcctctctactgggcctgccaagggtgcgtcctaaccggcgtctgggtcatagcccacgagtgcggccaccacgccttcagcgactac

SEQ ID NO: 33307 - DNA, 277 bp, Artificial
  Mutation in BnaC.FAD2.a introduced by TALE nuclease pair BnFAD2_T03
caggatccatgggtgcaggtgtaagaatgcaagtgtctcctccctccaagaagtctgaaaccgacaccatcaagcgcgtaccctgcgagacaccgcccttcactgtcgatcgagcgtttgaaacagtgcggtgggattgctttcttgagttctccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33308 - DNA, 285 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccgggtacgcgcttgatgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcatcgactac

SEQ ID NO: 33309 - DNA, 287 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccatcagcgactac

SEQ ID NO: 33310 - DNA, 342 bp, Artificial
  Mutation in BnaC.FAD2.a introduced by TALE nuclease pair BnFAD2_T03
caggatccatgggtgcaggtggaagaatgcaagtgagacctccgtccaagaagtctgaaaccgacaccatcaagcgcgtaccctgcgagacaccgcccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccggccgagggtgcgtcctaaccggcgtctgggtcatagcccacgagttcggccaccacgccatcaacaactac

SEQ ID NO: 33311 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccatctcctccctcaccctctctcctacttcgcctggcctctctactgggcctgccaaggctgcgtcctaacgggcctctgggtcatcgcccacgaatgcggccaccacgccttcagcgactac

SEQ ID NO: 33312 - DNA, 348 bp, Artificial
  Mutation in BnaC.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33313 - DNA, 334 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 33314 - DNA, 308 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagaaagcaatcccaccgcactgtttcaaacgctcgatccctcgctctttctcctacctcatctgggacatcatcatagcctcctgcttctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 33315 - DNA, 344 bp, Artificial
  Mutation in BnaC.FAD2.a introduced by TALE nuclease pair BnFAD2_T03
caggatccatgggtgcaggtggaagaatgcaagtgtctcctccatccaagaagtctgaaaccgacaccatccagcgcgtaccctgcgagacaccgcccttcactctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33316 - DNA, 419 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttgtccagcggctgttgccggtgctgtgccaggcccacggcttgaccccccagcaggtggtggccatcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33317 - DNA, 357 bp, Artificial
  Mutation in BnaC.FAD2.a introduced by TALE nuclease pair BnFAD2_T03
caggatccatgggtgcaggtggaagaatgcaagtgtctcctccctcccagaagtctgaaaccgacaccatcaagcgcgtaccctgcgagacaccgcccttcactgtttttgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactcggcctgccaagggtgcgtcctaaccggcgtctgggtcatagccctcgagtgctgccaccacgccttcagcgactac

SEQ ID NO: 33318 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33319 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccaccgcactgtttcaaacgctcgatccctcgctctttctcctacctcatctgggacatcatcatagcctcctgcttctactacgtcgccaccacttacttccctctcctccctcaacctctctcctacttcgcctggcctctctactgggcctgccaagggtgcgtcctaaccggcgtctgggtcatagcccacgagtgcggccaccacgccttcagcgactac

SEQ ID NO: 33320 - DNA, 350 bp, Artificial
  Mutation in BnaC.FAD2.a introduced by TALE nuclease pair BnFAD2_T03
caggatccatgggtgcaggtggaagaatgcaagtctatcctccctccagctcccccggaaccaacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33321 - DNA, 345 bp, Artificial
  Mutation in BnaC.FAD2.a introduced by TALE nuclease pair BnFAD2_T03
caggatccatgggtgcagggggaagaatgcaagtctctcctccctccagctcccccggaaccaacaccctcaaacgcgtcccctgcgagacaccaccattcactcctcaagaaagcaatcccacctcactgcttcaaacgctcgatccctcgctctttctcctacctcatctgagacatcatcatagcctcctgcttctactacgtcgccaccacttacttccctctcctccctcaccctctctcctacttcgcctggcctctctactcggcctgccaagggtgcgtcctaaccggcgtctgggtcatagcccacgagtgcggccaccacgccttcagcgactac

SEQ ID NO: 33322 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaacaaaaaccctcaaacgcgtcccctgcgagacaccacccttcactctgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33323 - DNA, 314 bp, Artificial
  Mutation in BnaC.FAD2.a introduced by TALE nuclease pair BnFAD2_T03
caggatccatgggtgcaggtggaagaatgcaagtgtctcctccctccaagaagactgaaaccgacaccatcaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33324 - DNA, 344 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33325 - DNA, 349 bp, Artificial
  Mutation in BnaC.FAD2.a introduced by TALE nuclease pair BnFAD2_T03
caggatccatgggtgcaggtgcaagaatgcaagtctctcctccctccagctcccccgaaaccaaaaccctcaaacgcgtcccctgcgagacaccacccttcactcagacctcaagaaagcaatcccaccgcactgtttcaaacgctcgatccctcgctctttctcctacctcatctgggacatcatcatagcctcctgcttctactacgttgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33326 - DNA, 335 bp, Artificial
  Mutation in BnaC.FAD2.a introduced by TALE nuclease pair BnFAD2_T03
caggatccatgggtgcaggtagaagaatgcaagtgaatcctccctacaagaagtctgaaaccgacaccatcaagcgcgtaccctgcgagacaccgcccttcactgagaactcaagaaagcaatcccaccgcactgtttcaaacgctccatcccacgctccttctcctcttcgacatcatcatctcctcctcggctcctccctctaccacctctccacagcctacttccctctcccttacctcgcctggcctctctactgcgccggccaagggtgcgtcctaacgggcctcggggtcagcgcccacgaatgcggccaccacgccttcagcgactac

SEQ ID NO: 33327 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33328 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccaccattcactcggacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33329 - DNA, 350 bp, Artificial
  Mutation in BnaC.FAD2.a introduced by TALE nuclease pair BnFAD2_T03
caggatccatggtgcaggtggaagaatgcaagtgtctactccctacaagaagtctgaaaccgacaccatcaagcgcgtaccctgcgagacaccgcccttcactgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33330 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 33331 - DNA, 331 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacaagaaagcaatcccaccgcactgtttcaaacgctcgaaccctcgctctttctcctcttcgccatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 33332 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 33333 - DNA, 343 bp, Artificial
  Mutation in BnaC.FAD2.a introduced by TALE nuclease pair BnFAD2_T03
caggatccatgggtgcagggggaagaatgcaagtctctcctccatcccgctcccccggaaccaacaccctcaaacgcgtcccctgcgagacaccaccattcacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33334 - DNA, 329 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 33335 - DNA, 308 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 33336 - DNA, 308 bp, Artificial
  Mutation in BnaC.FAD2.a introduced by TALE nuclease pair BnFAD2_T03
caggatccatgggtgcaggtggaagaatgcaagtgtctcattcctccaagaagactgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctcggggtcatcgcccacgaatgcggccaccacgccttcagcgactac

SEQ ID NO: 33337 - DNA, 327 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccctccactgtttcaaacgctcgatccctcgctctttctcctacctcatctgggacatcatcatagcctcctcggctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 33338 - DNA, 430 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgctgtgcctggcccacggcttgaccccccagcaggtggtggccatcgccagcaatggcggtggcaagcaggcgctggagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33339 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaaatcaagaaagcaatcccaccgcactgtttcaaacgctcgatccctcgctctttctcctacctcatctgggacatcagcatagcctcctgcttctactacgtcgccaccacttacttccctctcctccctcaccctctctcctgcttcgcctggcctctctacggggcctgccaaggctgcgtcctaacgggcctctgggtcatagcccacgagtgcggccaccacgccttcagcgactac

SEQ ID NO: 33340 - DNA, 331 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33341 - DNA, 332 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 33342 - DNA, 283 bp, Artificial
  Mutation in BnaC.FAD2.a introduced by TALE nuclease pair BnFAD2_T03
caggatccatgggtgcaggtggaagaatgcaagtgtctcctccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccacgacgccttcagcgactac

SEQ ID NO: 33343 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgacta

SEQ ID NO: 33344 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgctccctcgctctttctcctacctcatctgggacatcatcatagcctcctgcttctactacggcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 33345 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccaacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33346 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatcccacgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33347 - DNA, 357 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtttttgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33348 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 33349 - DNA, 351 bp, Artificial
  Mutation in BnaC.FAD2.a introduced by TALE nuclease pair BnFAD2_T03
caggatccatgggtgcagggggaagaatgcaagtctctcctccctccagctcccccggaaccaacaccctcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33350 - DNA, 333 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33351 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 33352 - DNA, 411 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgtacgtgccccacgagtacatcgagctgatcgagatcgaccggaccagcacccaggaccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 33353 - DNA, 447 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccccagcaggtggtggccatcgccagcaataatggcggcacgcaggcgctggagacggtgctgtgccaggcccacggcttgaccccccagcaggtggtggccatcgccagcaaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33354 - DNA, 466 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtggtccagcgcctgcttgccgccatcgtggctggcgatggccaccacctgctccggggtcaagccgtgggcctggcacagcaccggcaacagccgctggaccgtctccagcgcctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33355 - DNA, 304 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgaactcaagaaagcaatcccaccgcactgcttcaaacgctcgatccctcgctctttctcctacctcatctgggacatcatcatagcctcctgcttctactacgtcgccaccactacttccctctcctccctcaccctctctcctacttcgcctggcctctctactgggcctgccaagggtgcgtcctaaccggcgtctgggtcatagcccacgagtgcggccaccacgccttcaacgactac

SEQ ID NO: 33356 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagcctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33357 - DNA, 351 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgcctccagcgactac

SEQ ID NO: 33358 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaacaccctcaaacgcgtcccctgcgagacaccacccttcactggaactcaagaaagcaatcccaccgcactgtttcaaacgcccgatccctcgctctttctcctacctcatctgggacatcatcatcgcctcctgcttctactacggcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33359 - DNA, 308 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacactggagacggtctcgatccctcgctctttctcctacctcatctgggacatcatcatagcctcctgcttctactacgtcgccaccacttacttccctctcctccctcaccctctctcctacttcgcctggcccctctactgggcctgccaagggtgcgtcctaaccggcgtctgggtcatagcccacgagtgcggccaccacgccttcagcgactac

SEQ ID NO: 33360 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctcaccggcgtctgggtcatagcccacgagtgcggccaccacgccttcagcgactac

SEQ ID NO: 33361 - DNA, 341 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccgaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 33362 - DNA, 343 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33363 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 33364 - DNA, 371 bp, Artificial
  Mutation in BnaC.FAD2.a introduced by TALE nuclease pair BnFAD2_T03
caggatccatgggtgcaggtggaagaatgcaagtgtctccttcctccaagaagtctgaaaccgacaccatcaagcgcgtaccctgcgagacaccgcccttcactgttttgacggggtcagtgccttaagtactcaagaaagcaatcccaccgcactgtttcaaacgctcgatccctcgctctttctcctacctcatctgggacatcatcatagcctcctgcttctactacgtcgccaccacttacttccctctcctccctccccctctctcctacttcgcctggcctctctactgggcctgccaagggtgcgtcctaaccggcgtctgggtcatagcccacgagtgcggccaccacgccttcagcgactac

SEQ ID NO: 33365 - DNA, 341 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgggcctctctactgggcctgccaagggtgcgtcctaaccggcgtctgggtcatagcccacgagtgcggccaccacgccttcagcgactac

SEQ ID NO: 33366 - DNA, 391 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcaacagccgctggaccgtctccagcgcctgcttgccaccattattgctggcgagaactcaagaaagcaatcccaccgcactgtttcaaacgctcgatccctcgctctttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 33367 - DNA, 370 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcgttcggctgcggcgagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33368 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtacggccaccacgccttcagcgactac

SEQ ID NO: 33369 - DNA, 314 bp, Artificial
  Mutation in BnaC.FAD2.a introduced by TALE nuclease pair BnFAD2_T03
caggatccatgggtgcaggtggaagaatgcaagtgtctcctcactccaagaagtctgaaaccgacaccatcaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 33370 - DNA, 348 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcaccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33371 - DNA, 373 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacattaaccagctgcattaatgaatcggccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33372 - DNA, 343 bp, Artificial
  Mutation in BnaC.FAD2.a introduced by TALE nuclease pair BnFAD2_T03
caggatccatgggtgcagggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33373 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacttggcctgccaagggtgcgtcctaaccggcgtctgggtcatagcccacgagtgcggccaccacgccttcagcgactac

SEQ ID NO: 33374 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcgaccaccacgccttcagcgactac

SEQ ID NO: 33375 - DNA, 410 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttgcgtagattttcaggtttaacgtcagatgaatatacagtcacagtacccttaacatcagagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33376 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttcactctcctccctcaccctctctcctacttcgcctggcctctctactgggcctgccaagggtgcgtcctaaccggcgtctgggtcatcgcccacgaatgcggccaccacgccttcagcgactac

SEQ ID NO: 33377 - DNA, 341 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 33378 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtatcatcaagaaagcaatcccaccgcactgtttcaaacgctcgatccctcgctctttctcctacctcatctgggacatcatcatagcctcctggttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33379 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtgagaactcaagaaagcaatcccaccgcactgtttcaaacgcgcgatccctctctctttctcctacctcatctcggacatcatcatagcctcctgcctctactacacctccacctcctacttccctctcctccctaaccctctcccctacttcgcctggcctctctactgggcctgccaagggtgcgtcctaaccggcgtctgggtcatagcccacgagtgcggccaccacgccttcagcgactac

SEQ ID NO: 33380 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagcctgaaaccgacaccatcaagcgcgtaccctgcgagacaccgcccagcactcaagaaagcaatcccaccgcactctttcaaacgctcgatccctcgctctttctcctaccccacctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33381 - DNA, 401 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacggtccagcggctgttgccgccatcgtggctggcgatggccaccacctgctccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgtgtcctaaccggcgtctgggtcatagcccacgagtgcggccaccacgccttcagcgactac

SEQ ID NO: 33382 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctccatcccacgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33383 - DNA, 351 bp, Artificial
  Mutation in BnaC.FAD2.a introduced by TALE nuclease pair BnFAD2_T03
cagtatccatgggtgcaggtggaagaatgcaagtctctcctccctccagctcccccggaaccaacaccctcaaacgcgtcccctgcgagacaccaccattcactctcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 33384 - DNA, 354 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgattgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 33385 - DNA, 343 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 33386 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccaagggtgcgtcctaaccggcgtctgggtcatagcccacgagtgcggccaccacgccttcagcgactac

SEQ ID NO: 33387 - DNA, 283 bp, Artificial
  Mutation in BnaC.FAD2.a introduced by TALE nuclease pair BnFAD2_T03
caggatccatgggtgcaggtggaagaatgcaagtgtctcctccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttgcctggcctctctactgggcctgccaagggtgcgtcctaaccggcgtctgggtcatagcccacgagtgcggccaccacgccttcagcgactac

SEQ ID NO: 33388 - DNA, 354 bp, Artificial
  Mutation in BnaC.FAD2.a introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctcgggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 33389 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacctggcctctctactgggcctgccaagggtgcgtcctaacgggcctctgggtcatagcccacgagtgcggccaccacgccttcagcgactac

SEQ ID NO: 33390 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcccctggcctctctactgggcctgccaagggtgcgtcctaacgggcctctgggtcatagcccacgagtgcggccaccacgccttcagcgactac

SEQ ID NO: 33391 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctgtctcctacctcatctgggacatcatcatagcctcctgcttctactacgtctccaccacttacttccctctcctccctcaccctctctcctccttcgcctggcctctctactgggcctgccaagggtgcgtcctaaccggcgtctgggtcatagcccacgagtgcggccaccacgcctgcagcgactac

SEQ ID NO: 33392 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcacaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 33393 - DNA, 341 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 33394 - DNA, 305 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcggggtcatagcccacgagtgcggccaccacgccttcagcgactac

SEQ ID NO: 33395 - DNA, 325 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgtcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33396 - DNA, 308 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcctctgggtcatagcccacgagtgcggccaccacgccttcagcgactac

SEQ ID NO: 33397 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33398 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcgtctgggtcatagcccacgagtgcggccaccacgccttcagcgactac

SEQ ID NO: 33399 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactag

SEQ ID NO: 33400 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaatggtgcgtcctaaccggcgtctgggtcatagcccacgagtgcggccaccacgccttcagcgactac

SEQ ID NO: 33401 - DNA, 308 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaagaaagcaatcccaccgcactgtttcaaacgctcaatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33402 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcacgtaccctgcgagataccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcattcagcgactac

SEQ ID NO: 33403 - DNA, 432 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgacacacgaagcgatcgttggcgtcggcaaacaggtggaaataatatggattgggataaataatatggctgtttattttgtaactggcaagaaagcaatcccaccgcactgtttcaaacgctcgatccctcgctctttctcctacctcatctgggacatcatcatagccgcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33404 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacctcatcatagccccctgcttctactacgtcgccaccccttacttcccccccctccctcaccctctctcctacttcgcctggcctctctactgggcctgccaagggtgcgtcctaaccggcgtctgggtcatagcccacgagtgcggccaccacgccttcagcgactac

SEQ ID NO: 33405 - DNA, 356 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33406 - DNA, 392 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgcctgcttgccaccgccattgctggcgatggccaccacctttgacctcaagaaagcaatcccacctcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaaccggcgtctgggtcatagcccacgagtgcggccaccacgccttcagcgactac

SEQ ID NO: 33407 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcattgcccacgagtgcggccaccacgccttcagcgactac

SEQ ID NO: 33408 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccaaggctgcgtcctaacgggcctctgggtcatagcccacgagtgcggccaccacgccttcagcgactac

SEQ ID NO: 33409 - DNA, 350 bp, Artificial
  Mutation in BnaC.FAD2.a introduced by TALE nuclease pair BnFAD2_T03
caggatccatgggtgcaggtggaagaatgcaagtctctcctccctccaagtagcctgaaaccgacaccctcaaacgcgtaccctgcgagacaccgcccttcactgtagaactcaagaaagcaatcccaccgcactgtttcaaacgctccatccctcgctctttctcctacctcatctgcgacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33410 - DNA, 348 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagcgtgcgtcctaaccggcgtctgggtcatagcccacgagtgcggccaccaccccttcagcgactac

SEQ ID NO: 33411 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccctccactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgagtgcggccaccacgccttcagcgactac

SEQ ID NO: 33412 - DNA, 349 bp, Artificial
  Mutation in BnaC.FAD2.a introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33413 - DNA, 287 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacacagcccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagctcacgagtgcggccaccacgccttcagcgactac

SEQ ID NO: 33414 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 33415 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatcttggacatcatcatagcctcctgcttctactacgtcgccaccacttacttccctctcctccctcaccctctctcctacttcgcctggcctctctactgggcctgccaggggtgcgtcctaaccggcgtctgggtcatagcccacgagtgcggccaccacgccttcagcgactac

SEQ ID NO: 33416 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33417 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccatcaccctctctcctacttcgcctggcctctctactgggcctgccaaggctgcgtcctaacgggcctctgggtcatagcccacgagtgcggccaccacgccttcagcgactac

SEQ ID NO: 33418 - DNA, 330 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaccatcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 33419 - DNA, 350 bp, Artificial
  Mutation in BnaC.FAD2.a introduced by TALE nuclease pair BnFAD2_T03
caggatccatgggtgcaggtggaagaatgcaagcgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 33420 - DNA, 478 bp, Artificial
  Mutation in BnaC.FAD2.a introduced by TALE nuclease pair BnFAD2_T03
caggatccatggtgcaggtggaagaatgcaagtgtctcctccctccaagaagtctgaaaccgacaccatcaagcgcgtaccctgcgagacaccgcccttcactggaatgtcattgcgctgccattctccaaattgcagttcgcgcttagctggataacgccacggaatgatgtcgtcgtgcacaacaatggtgacttctacagcgcggagaatctcgctctctccaggggaagccgaactcaagaaagcaatcccaccgcactgtttcaaacgctcgatccctcgctctttctcctacctcacctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33421 - DNA, 364 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtccccacgcgtcccagcaatggcggtggcaagcaggcgctggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33422 - DNA, 340 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgattgtagaactcaagaaagcaatcccacctcactgcttcaaacgctccatcccacgctccttctcctcttcgacatcatcatctcctcctcgactcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 33423 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgcaaagggtgcgtcctaaccggcgtctgggtcatagcccacgagtgcggccaccacgccttcagcgactac

SEQ ID NO: 33424 - DNA, 350 bp, Artificial
  Mutation in BnaC.FAD2.a introduced by TALE nuclease pair BnFAD2_T03
caggatccatgggtgcaggtggaagaatgcaagtgtctcctccctccagctcccccggaaccaacaccctcaaacgcgtcccctgcgagactccaccattcactggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33425 - DNA, 340 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtacggctgcggcgagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 33426 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcccaaccggcgtctgggtcatagcccacgagtgcggccaccacgccttcagcgactac

SEQ ID NO: 33427 - DNA, 356 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcggcggagaactcaagaaagcaatcccaccgcactgtttcaaacgctcgatccctcgctctttctcctacctcatccgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 33428 - DNA, 333 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 33429 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaactcaagaaagcaatcccaccgcactgtttcaaacgctcgatccctcgctctttctcctacctcatctgggacatcatcatagcctcctgcttctactacgtcgccaccacttacttccctctcctccctcaccttctctcctacttcgcctggcccctctactgggcctgccaaggctgcgtcctaacgggcctctgggtcatcgcccacgaatgcggccaccacgccttcagcgactac

SEQ ID NO: 33430 - DNA, 347 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33431 - DNA, 317 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33432 - DNA, 345 bp, Artificial
  Mutation in BnaC.FAD2.a introduced by TALE nuclease pair BnFAD2_T03
caggatccatgggtgcaggtggaagaatgcaagtctctcctccctccaagaagcccgaaaccgacaccatcaagcgcgtaccctgcgagacaccccccttcactcctcaagaaagcaatcccaccacactgtttcaaacgctcaatccctcgctccttctcctacctcatctgagacatcaccatagcctcctccatctactacgtcgccaccgcttacttccctctcctccctcaccctctctcctacttcgcctggcctctctactgggcctgccaaggctgcgtcctaacgggcctctgggtcatagcccacgaatgcggccaccacgccttcagcgactac

SEQ ID NO: 33433 - DNA, 357 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33434 - DNA, 343 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33435 - DNA, 336 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcagaactcaagaaagcaatcccaccgcactgtttcaaacgctcgatccctcgctccttctcctacctcctcttcgacatcctcgtctcctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 33436 - DNA, 349 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgagaactcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatagcccacgagtgcggccaccacgccttcagcgactac

SEQ ID NO: 33437 - DNA, 408 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggacttcgctgctacccaaggttgccgggtgacgcacaccgtggaaacggatgaaggagaactcaagaaagcaatcccaccgcactgtttcaaacgctcgatccctcgctctttctcctacctcatctgggacatcatcatagccccctgcttctaccaccgctccacagcctacttccctctccccccccaccctctcccttacctcgcctggcccctctacggggcctgccaaggctgcgtcctaacgggcctctgggtcatagcccacgagtgcggccaccacgccttcagcgactac

SEQ ID NO: 33438 - DNA, 333 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgagcccccgatttagagcttgacggggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33439 - DNA, 412 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgacggatggcctttttgcgtttctacaaactcttcctggctagcggtacgcgtattaattgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33440 - DNA, 429 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactctcggcgctggagacggtccagcggctgttgccggtgctgtgccaggcccacggcttgaccccccagcaggtggtggccatagacctcaagaaagcaatcccacctcactgcttcaaacgctccatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 33441 - DNA, 348 bp, Artificial
  Mutation in BnaC.FAD2.a introduced by TALE nuclease pair BnFAD2_T03
caggatccatgggtgcaggtggaagaatgcaagtgtctccttcctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33442 - DNA, 404 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtctccagcgcctgcttgccgccatcgtggctggcgatggccaccacctgctccggagaactcaagaaagcaatcccaccgcactgtttcaaacgctcgatccctctctctttctcctacctcatctgggacatcatcatagcctcctgcttcgcctacgtcgccaccacttacttccctctcctccctcaccctctctcctacttcgcctggcctctctactgggcctgccaagggtgcgtcctaaccggcgtcttggtcatagcccacgagtgcggccaccacgccttcagcgactac

SEQ ID NO: 33443 - DNA, 339 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 33444 - DNA, 314 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaaactcaagaaagcaatcccaccgcactgtttcaaacgctcgatccctcactctttctcctacctcatctgggacatcatcatagcctcctgcttctactacgtcgccaccacttacttccctctcctccctcaccctctctcctacttcgcctggcctatctactgggcctgccaagggtgcgtcctaaccggcgtctgggtcatagcccacgagtgcggccaccacgccttcagcgactac

SEQ ID NO: 33445 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacttagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33446 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 33447 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactggttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33448 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33449 - DNA, 396 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacggatggccttctgcttagtttgatgcctggcagtttatggcgggcatactcaagaaagaaaacccaccgcactgtttcaaaagctcgatccctcgctctttctcctacctcatctgggacatcatcatagcctcctgcttctactacgtcgccaccacttacttccctcccctccctcaccctctctcctacttcgcctggcccctctactgggcctgccaaggctgcgtcctaacgggcctctgggtcatagcccacgagtgcggccaccacgccttcagcgactac

SEQ ID NO: 33450 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 33451 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaagaactcaagaaagcaatcccaccgcattgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33452 - DNA, 331 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33453 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactaaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33454 - DNA, 395 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggtggccatcgccagcaatggcggtggcaagcaggcgctggagacggagaactcaagaaagcaatcccaccgcactgtttcaaacgctcgatccatcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 33455 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgtcaagggtgcgtcctaaccggcgtctgggtcatagcccacgagtgcggccaccacgccttcagcgactac

SEQ ID NO: 33456 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgcccccacttacttccctctcctccctcaccctctctcctacctcgcctggcctctctactgggcctgccaagggtgcgtcctaaccggcgtctgggtcatagcccacgagtgcggccaccacgccttcagcgactac

SEQ ID NO: 33457 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctctttctcctacctcatctgggacatcatcatagcctcctgcttctactacgtcgccaccacttacttccctctcctccctcaccctctctcctacttcgcctggcctctctacttggcctgccaagggtgcgtcctaaccggcgtctgggtcatagcccacgagtgcggccaccacgccttcagcgactac

SEQ ID NO: 33458 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33459 - DNA, 359 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgtctccagcgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcccctggcctctctactgggccggccaagggtgcgtcctaaccggcgtctgggtcatagcccacgagtgcggccaccacgccttcagcgactac

SEQ ID NO: 33460 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 33461 - DNA, 450 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgttgagcgatcgttggcgtcggcaaacagtggtccggcgcacgcgctctggaggccttgctcacggtggcgggagagttgagaggtccaccgttacagttggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33462 - DNA, 350 bp, Artificial
  Mutation in BnaC.FAD2.a introduced by TALE nuclease pair BnFAD2_T03
caggatccatgggtgcaggtggaataatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 33463 - DNA, 348 bp, Artificial
  Mutation in BnaC.FAD2.a introduced by TALE nuclease pair BnFAD2_T03
caggatccatgggtgcaggtggaagaatgcaagtctctcctccctccatctcccccgacacccacaccctcacacgcgtaccctgcgagacacccccattcactatacctcaagcgagccatcccaccgcactgtttcacacgctcgatccctcgctctttctcctacctcatctgggacatcatcatagcctcctgcttctactacgtcgccaccacttacttccctcgcctccctcaccctctctcctacttcgcctggcctctctactgggccagccaagggtgcgtcctaaccggcgtctgggtcatagcccacgagtgcggccaccacgccttcagcgactac

SEQ ID NO: 33464 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctggatcatagcccacgagtgcggccaccacgccttcagcgactac

SEQ ID NO: 33465 - DNA, 288 bp, Artificial
  Mutation in BnaC.FAD2.a introduced by TALE nuclease pair BnFAD2_T03
caggatccatgggtgcaggtggaagaatgcaagtgtctcctccctccaagtgtctcctccctcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33466 - DNA, 333 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33467 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgtgtaccctgcgagacaccgcccttcactgtagaactcaagaaagcaatcccaccgcactgtttcaaacgctcgatccctcgctctttctccttcctcatctgggacatcatcatagcctcctgcttctactacgtcgccaccacttacttccctctcctccctcaccctctctcctgcctcgcctggcctctctacggggcctgccaagggtgcggcctgaccggcgtctgggtcatagcccacgagtgcggccaccacgccttcagcgactac

SEQ ID NO: 33468 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33469 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccatcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 33470 - DNA, 350 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccatgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33471 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaagaactcaagaaagcaatcccaccgcactgtttcaaacgctcgatccctctctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33472 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggggacctcacgaaagcaatccaaccgcactgtttcaaacgctcgatccctctctctttctcctacctcatctgggacatcatcatagcctcctgcttctcctacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33473 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtctggcctctctactgggcctgccaagggtgcgtcctaaccggcgtctgggtcatagcccacgagtgcggccaccacgccttcagcgactac

SEQ ID NO: 33474 - DNA, 347 bp, Artificial
  Mutation in BnaC.FAD2.a introduced by TALE nuclease pair BnFAD2_T03
caggatccatggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 33475 - DNA, 331 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 33476 - DNA, 338 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33477 - DNA, 347 bp, Artificial
  Mutation in BnaC.FAD2.a introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33478 - DNA, 308 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33479 - DNA, 347 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33480 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 33481 - DNA, 282 bp, Artificial
  Mutation in BnaC.FAD2.a introduced by TALE nuclease pair BnFAD2_T03
caggatccatgggtgcaggtggtggggtcaagccgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgaatgcggccaccacgccttcagcgactac

SEQ ID NO: 33482 - DNA, 350 bp, Artificial
  Mutation in BnaC.FAD2.a introduced by TALE nuclease pair BnFAD2_T03
caggatccatgggtgcaggtggaagaatgcaagtgtctcctccctccagctcccccgaaaccaaaaccctcaaacgcgtcccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 33483 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgtgacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 33484 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctctctctttctcctacctcatctgggacatcatcatagcctcctgcttctactacgtcgccaccacttacttccctctcctccctcaccctctctcctacttcgcctggcctctctactgggcctgccaaggttgcgtcctaacgggcctctgggtcatcgcccacgaatgcggccaccacgccttcagcgactac

SEQ ID NO: 33485 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactcgaacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33486 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33487 - DNA, 336 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctccatcccacgctccttctcctcttcgacatcatcatctcctcctcggctcctccctctaccacctctccacagcctacttccctctcccttgcctcgcctgacccctctactgggcctgccaagggtgcgtcctaaccggcgtcggggtcatagcccacgagtgcggccaccacgccttcagcgactac

SEQ ID NO: 33488 - DNA, 424 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttcgttggtcaacgcggccaacgccggatcagggcgagataactgggcaacaatgctctccagcgcctgttgccggtgctgtgccaggccgaactcaagaaagcaatcccaccgcactgtttcaaacgctcgatccctcgctctttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 33489 - DNA, 412 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgacggatggcctttttgcgtttctacaaactcttcctggctagcggtacgcgtattaattgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 33490 - DNA, 407 bp, Artificial
  Mutation in BnaC.FAD2.a introduced by TALE nuclease pair BnFAD2_T03
caggatccatgggtgcaggtggaagaatgcaagtctctcctccatccagctcccccggaaccaacaccctcaaacgcgtcccctgcgagacaccacccttcactctcggtccagcggctgttgccggtgctgggaagccgaagtttccaaaaggtcgttgatcaaacctcaagaaagcaatcccaccgcactgtttcaaacgctcgatccctcgctctttctcctacctcatctgggacatcatcatagcctcctgcatctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33491 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctactgcttctactacgtcgccaccacttacttccctctcctccctcaccctctctcctacttcgcctggcctctctactgggcctgccaagggtgcgtcctaaccggcgtcggggtcatagcccgcgagtgcggccaccacgccttcagcgactac

SEQ ID NO: 33492 - DNA, 358 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtcggggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 33493 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 33494 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcaaagcccacgagtgcggccaccacgccttcagcgactac

SEQ ID NO: 33495 - DNA, 343 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacctcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 33496 - DNA, 390 bp, Artificial
  Mutation in BnaC.FAD2.a introduced by TALE nuclease pair BnFAD2_T03
caggatcctgggtgcaggtggaagaatgcaagtgtctcctccctccaagaagtctgaaaccgacaccatcaagcgcgtaccctgcgagacaccgcccttcactgtacggtccagcggctgttgccggtgctgtgccaggcccacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 33497 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33498 - DNA, 349 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33499 - DNA, 332 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctcggggtcatcgcccacgaatgcggccaccacgccttcagcgactac

SEQ ID NO: 33500 - DNA, 414 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggagacggtccagcggctgttgccggtgctgtgccaggcccacggtccagcggctgttgccggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 33501 - DNA, 332 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcttggtcatagcccacgagtgcggccaccacgccttcagcgactac

SEQ ID NO: 33502 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctctccctctctcctacttcgcctggcctctctactgggcctgccaagggtgcgtcctaaccggcgtctgggtcatagcccacgagtgctgccaccgcgccttcagcgactac

SEQ ID NO: 33503 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 33504 - DNA, 444 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgtgggcctggcacagcaccggcaacagcgcctgcaccgtctccagcgctggtttgccaccaatattgctggcgatggccaccacctgctacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33505 - DNA, 343 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgtgcctgccaagggtgcgtcctaaccggcgtctgggtcatagccgacgagtgcggccaccgcgccttcagcgactac

SEQ ID NO: 33506 - DNA, 391 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacggtccagcggctgttgccggtgctgtgccaggcccacggagaactcaagaaagcaatcccaccgcactgtttcaaacgctcgatccctcgctctttctcctacctcatctgggacatcatcatagcctcctgcttctactacgtcgccaccacttacttccctctcctccctcacccgctctcctacttcgcctggcctctctactgggcctgccaagggtgcgtcctaaccggcgtctgggtcatatcccacgagtgcggccaccacgccttcagcgactac

SEQ ID NO: 33507 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccaccgcactgtttcaaacgcccgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33508 - DNA, 347 bp, Artificial
  Mutation in BnaC.FAD2.a introduced by TALE nuclease pair BnFAD2_T03
caggatccatgggtgcaggtggaagaatgcaagtttctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33509 - DNA, 326 bp, Artificial
  Mutation in BnaC.FAD2.a introduced by TALE nuclease pair BnFAD2_T03
caggatccatgtgtgcaggtggaagaatgcaagtgtctcctccctccaagaagtctgaaaccgacaccatcaagcgcgtaccctgcgagacaccgcccttcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33510 - DNA, 333 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 33511 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33512 - DNA, 350 bp, Artificial
  Mutation in BnaC.FAD2.a introduced by TALE nuclease pair BnFAD2_T03
caggatccatgggtgcaggttgaagaatgcaagtctctcctccctccagctcccccgaaaccaaaaccctcaaacgcgtcccctgcgagacaccacccttcactctagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33513 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 33514 - DNA, 450 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttgagcgatcgttggcgtcggcaaacagtggtccggcgcacgcgctctggaggccttgctcacggtggcgggagagttgagaggtccaccgttacagttggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33515 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccaccattcactcttgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33516 - DNA, 340 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctacggggcctgccaaggctgcgtcctaacgggcctctgggacatagcccacgagtgcggccaccacgccttcagcgactac

SEQ ID NO: 33517 - DNA, 325 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtatagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccagccaagggagcgaccgaaccggcgaaggggacaaagcccacgagtgcggccaccaagccttcagcgactac

SEQ ID NO: 33518 - DNA, 335 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 33519 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgaactaaagaaagcaatcccaccgcactgtttcaaacgcccgatccctcgctccttctcctacctcctcttcgacatcatcatcacctcctccctctaccacctctccacaacctacttccctctcctcccccaccctctcccctacctcgcctggcccctctactgggcctgccaagggtgcgtcctaaccggcgtctgggtcatagcccacgagtgcggccaccacgccttcagcgactac

SEQ ID NO: 33520 - DNA, 456 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcggctgttgccggtgctgtgccaggcccacggcttgaccccggagcaggtggtggccatcgccagcaatattggtggcaagcaggcgctggagacggtgcaggagaactcaagaaagcaatcccaccgcactgtttcaaacgctcgatccctcgctctttctcctacctcatctgggacatcatcatagcctcctgcttctactacgtcgccaccacttacttccctctccgccctcaccctctctcctacttcgcctggcctctctactgggcctgccaagggtgcgtcctaaccggcgtctgggtcatagcccacgagtgcggccaccacgccttcagcgactac

SEQ ID NO: 33521 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttagaactcaagaaagcaatcccaccgcactgtttcaaacgctcgatccctccttctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33522 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 33523 - DNA, 456 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaccacctgctggggggtcaagccgtgggcctggcacagcaccggcaacagccgctggaccgtctccagcgcctgcttgccaccattattgctggcgatggccaccaagaactcaagaaagcaatcccaccgcactgtttcaaacgctcgatccctcgctctttctcctacctcacctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33524 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagtaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 33525 - DNA, 290 bp, Artificial
  Mutation in BnaC.FAD2.a introduced by TALE nuclease pair BnFAD2_T03
caggatccatgggtgcaggtggaagaatgcaagtctctcctctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33526 - DNA, 350 bp, Artificial
  Mutation in BnaC.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccacctcgccttcagcgactac

SEQ ID NO: 33527 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagacctctgaaaccaacaccatcaagcgcgtcccctgcgagacaccaccattcactataactcacgaaagcaatcccaccgcactgcttcaaacgcacgatccctcgctctttctcctacctcatctgggacatcatcatagcctcctgcttctactacaccgccaccacctacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 33528 - DNA, 382 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacagccgctggaccgtctccagcgcctgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcgtctgggtcatagcccacgagtgcggccaccacgccttcagcgactac

SEQ ID NO: 33529 - DNA, 345 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33530 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccacctcttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33531 - DNA, 352 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 33532 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgggagaactcaagaaagcaatcccaccgcactgtttcaaacgctcgatccctcgctctttctcctacctcatctgggacatcatcatagcctcctgcttctactacgtcgccaccacttacttccctctcctccctcaccatctctcctacttcgcctggcctctctactgggcctgccaaggctgcgtcctaacgggcctctgggtcatagcccacgagtgcggccaccacgccttcagcgactac

SEQ ID NO: 33533 - DNA, 354 bp, Artificial
  Mutation in BnaC.FAD2.a introduced by TALE nuclease pair BnFAD2_T03
caggatccatgggtgcaggtggaagaatgcaagtgtctcctccctcccagaagtctgaaaccgacaccatcaagcgcgtaccctgcgagacaccgcccttcactgattgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaactggcctctgggtcatcgcccacgaatgcggccaccacgccttcagcgactac

SEQ ID NO: 33534 - DNA, 351 bp, Artificial
  Mutation in BnaC.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccgcgagtgcggccaccacgccttcagcgactac

SEQ ID NO: 33535 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccaccgcactgtttcaaacgctcgatccctcgctctttctcctacctcatctgggacatcatcatagcctcctgcttctactacgtcgccaccacttacttccctctcctcccccaccctctctcctacttcgcctggcctctctactgggcctgccaagggtgcgtcctaaccggcgtctgggtcatagcccacgagtgcggccaccacgcctcagcgactac

SEQ ID NO: 33536 - DNA, 277 bp, Artificial
  Mutation in BnaC.FAD2.a introduced by TALE nuclease pair BnFAD2_T03
caggatccatgggtgcaggggtaagaatgcaagtgtctcctccctccaagaagtctgaaaccgacaccatcaagcgcgtaccctgcgagacaccgcccttcactgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33537 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgagtgcggccaccacgccttcagcgactac

SEQ ID NO: 33538 - DNA, 411 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaggtcttgaccccggagcaggtggtggccatcgccagccacgatggcggcaagcaggcgctggagaagaactcaagaaagcaatcccaccgcactgtttcaaacgctcgatccctcgctctttctcctacctcatctgggacatcatcatagcctcctgcttctactacgtcgccaccacttacttccctctcctccctcaccctttctcctacttcgcctggcctctctactgggcctgccaagtgtgcgtcctaaccggcgtctgggtcatagcccacgagtgcggccaccacgccttcagcgactac

SEQ ID NO: 33539 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagctactac

SEQ ID NO: 33540 - DNA, 343 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctccctctttctcctacctcatctgggacatcatcatagcctcctcggctcctccctctcccacctctccacagcctccttctctctcccttacctcgcctgacccctctactgggcctgccaaggctgcgtcctaacgggcctctgggtcatagcccacgagtgcggccaccacgccttcagcgactac

SEQ ID NO: 33541 - DNA, 347 bp, Artificial
  Mutation in BnaC.FAD2.a introduced by TALE nuclease pair BnFAD2_T03
caggatccatgggtgcaggtggaagaatgcaagtgtctcatccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctccccctctctcctacttcgcctagcctctctactgggcctgccaagggtgcgtcctaaccggcctctgggtcatagcccacgagtgcggccaccacgccttcagcgactac

SEQ ID NO: 33542 - DNA, 320 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccctcaagcgcgtaccctgcgagacaccgccctccactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggggcgtcctaaccggcggctgggtcatagcccacgagtgcggccaccacgccttcatcgactacc

SEQ ID NO: 33543 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 33544 - DNA, 388 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactcacccgtcagtgcattgcgccatgcatgcactgcctccagagaactcaagaaagcaatcccaccgcactgtttcaaacgctcgatccctcgctctttctcctacctcatctgggacatcatcatagcctcctgcttctactacgtcgccaccacttacttccctctcccccctcaccctctctcctacttcgcctggcctctctacggggcctgccaatggtgcgtcctaaccggcgtctgggtcatagcccacgagtgcggccaccacgccttcagcgactac

SEQ ID NO: 33545 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatcactcgctctttctcctacctcatctgggacatcatcatagcctcctgcttcttctacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33546 - DNA, 314 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 33547 - DNA, 358 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgtcggggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccggccaagggtgcgtcctaaccggcgtctgggtcatagcccacgagtgcggccacctcgccttcagcgactac

SEQ ID NO: 33548 - DNA, 352 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaccgcgtcccctgcgagacaccacccttcactctagagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacgtcgcctggcctctctactgggcctgccaagggtgcgtccgaaccggcgtcggggtcatagcccacgagtgcggccaccacgccatcagcgactac

SEQ ID NO: 33549 - DNA, 348 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33550 - DNA, 305 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcggggtcatagcccacgagtgcggccaccacgccatcagcgactac

SEQ ID NO: 33551 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccactccttcagcgactac

SEQ ID NO: 33552 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgattgcggccaccacgccttcagcgactac

SEQ ID NO: 33553 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagctactac

SEQ ID NO: 33554 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttagaactcaagaaagcaatcccaccgcactgattcaaacgctcgatccctcgctctttctcctacctcatctgggacatcctcatagcctcctgcttctactacgtcgccacaacttacttccctctcctccctcaccctctctcctccttcgcctggcctctctactgggcctgccaagggtgcgtcctaaccggcgtctgggtcatagcccacgagtgcggccaccacgccttcagcgactac

SEQ ID NO: 33555 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcacgtaccctgcgagacaccgcccttcactaactcaagaaagcaatcccaccgcactgtttcaaactctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33556 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcggggtcatagcccacgagtgcggccaccacgccttcagcgactac

SEQ ID NO: 33557 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgtggccaccacgccttcagcgactac

SEQ ID NO: 33558 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagttccgccaccacgccttcagcgactac

SEQ ID NO: 33559 - DNA, 341 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagatagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 33560 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtccgaaccggcgtcggggtcatagcccacgagtgcggccaccacgccttcagcgactac

SEQ ID NO: 33561 - DNA, 347 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33562 - DNA, 346 bp, Artificial
  Mutation in BnaC.FAD2.a introduced by TALE nuclease pair BnFAD2_T03
caggatccatgggtgcaggtgcaagaatgcaagtgtctcctccctccaagaagcctgaaaccgacaacatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccacctcttacttccctctcctccctcaccctctctcctacttcgcctggcctctctactgggcctgccaagggtgcgtcctaaccggcttcggggtcatagcccgcgagtgcggccaccacgccttcagcgactac

SEQ ID NO: 33563 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 33564 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccttcaagcgcgtaccctgcgagacaccgcccttcactgaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33565 - DNA, 343 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcggggtcatagcccacgagtgcggccaccacgccttcagcgactac

SEQ ID NO: 33566 - DNA, 354 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtccgaaccggcgtctgggtcatagcccacgagtgctgccaccgcgccttcagcgactac

SEQ ID NO: 33567 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 33568 - DNA, 348 bp, Artificial
  Mutation in BnaC.FAD2.a introduced by TALE nuclease pair BnFAD2_T03
caggatccatgggtgcaggtggaagaatacaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagtgtgcgtcctaaccggcgtctgggtcatggcccacgagtgcggcgacgacgccattagcgactac

SEQ ID NO: 33569 - DNA, 341 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcttggtcatagcccacgagtgcggccaccacgccatcagcgactac

SEQ ID NO: 33570 - DNA, 277 bp, Artificial
  Mutation in BnaC.FAD2.a introduced by TALE nuclease pair BnFAD2_T03
caggatccatgggtgcaggtggaagaatgcaagtgtctcctccccccaagaagtctgaaaccgacaccatcaagcgcgtaccctgcgagacaccgcccttcactgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33571 - DNA, 339 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccatcaagcgcgtaccctgcgagacaccgccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33572 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaataccctcaaacgcgtcccctgcgagacaccaccattcactgagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 33573 - DNA, 280 bp, Artificial
  Mutation in BnaC.FAD2.a introduced by TALE nuclease pair BnFAD2_T03
caggatccatgggtgcaggtggaagaatgcaagtgtctcctccctccaagaagcctgaaaccgacaccatcaagcgcgtaccctgcgagacaccgcccttcactgtcgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33574 - DNA, 348 bp, Artificial
  Mutation in BnaC.FAD2.a introduced by TALE nuclease pair BnFAD2_T03
caggatccatgggtgcaggtggaagaatgcaagtgtatcctacctccaagtagaccgaaaccgacaccgtcaaacgcgtaccctgcgagacaccgcccttcactgtaactcaagaaaacaatcccaccccactgttccaaaccctccatccctccctctttctcctccctcatctgcgacatcatcatctcctcctccctctactacatcgccaccgcctacttcccgctcctccctcaccctctcgcctacctcgcctggcctctctactgggccggccaaggctgcgtcctaaccggcgtcggggtcatagcccacgagtgcggccacctcgccttcagcgactac

SEQ ID NO: 33575 - DNA, 349 bp, Artificial
  Mutation in BnaC.FAD2.a introduced by TALE nuclease pair BnFAD2_T03
caggatccatgggtgcaggtggaagaatgcaagtgtctcctcactccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33576 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33577 - DNA, 319 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgagtcctaaccggcgtctgggtcatagcccacgagtgcggccaccacgccttcagcgactac

SEQ ID NO: 33578 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccctccactgtttcaaacgctcgatccctcgctctttctcctacctcatctgggacatcatcatagccacctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33579 - DNA, 305 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33580 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccattaagccacgatggcggcaagcaggcgctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 33581 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 33582 - DNA, 408 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttggccaccacctgctccggggtcaagctggaggggtacaccttccaccactcgttgggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcagagcccacgagtgcggccaccacgccttcagcgactac

SEQ ID NO: 33583 - DNA, 317 bp, Artificial
  Mutation in BnaC.FAD2.a introduced by TALE nuclease pair BnFAD2_T03
caggatccatggtgcaggtggaagaatgcaagtctctcctccctccagctcccccggaaccaacaccctcaaacgcgtcccctgcgagacaccaccattcactctcactgcttcaaacgctccatcccacgctccttctcctcttcgacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33584 - DNA, 356 bp, Artificial
  Mutation in BnaC.FAD2.a introduced by TALE nuclease pair BnFAD2_T03
caggatccatgggtgcaggtggaagaatgcaagtgtctcctccctccaagaagcctgaaaccgacaccctcaagcgcgtaccctgcgagacaccgcccttcactgtcggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccgtcagcgactac

SEQ ID NO: 33585 - DNA, 359 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgtctccagcgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgattgcggccaccacgccttcagcgactac

SEQ ID NO: 33586 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33587 - DNA, 343 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccgagaactcaagaaagcaatcccaccgcactgtttcaaacgctcgatccctcgctctttctcctacctcatctgggacatcatcatagcctcctgcttctactacgtcgccaccccttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 33588 - DNA, 337 bp, Artificial
  Mutation in BnaC.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactgtgagacctcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 33589 - DNA, 349 bp, Artificial
  Mutation in BnaC.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33590 - DNA, 442 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgtcggctgttgccggagctgtgccaggcccacggcttgaccccggagcaggcggtggccctcgccagccacgatggcggcaacagccgctggacagaactcaagaaagcaatcccaccgcactgtttcaaccgctcgacccctcgctctttctcctaccccacctgggacatcatcatagcctcctgcttctacgacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33591 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 33592 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagactgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33593 - DNA, 350 bp, Artificial
  Mutation in BnaC.FAD2.a introduced by TALE nuclease pair BnFAD2_T03
caggatccatgggtgcaggcggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33594 - DNA, 319 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgggacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcaacgactac

SEQ ID NO: 33595 - DNA, 432 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgcgagacaccaccatgcaagtctctcctccctccagctcccccggaaccaacaccctcaaacgcgtcccctgcgagccaccaccacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33596 - DNA, 334 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtatcccaccgcactgtttcaaacgctcgatccctcgctctttctcctacctcatctgggacatcatcatagcctcctgcttctactacgtcgccaccacttacttccctctcctccctcaccctctatcctacttcgcctggcctctctactgggcctgccaagggtgcgtcctaaccggcgtctgggtcatagcccacgagtgcggccaccacgccttcagcgactac

SEQ ID NO: 33597 - DNA, 332 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcccaccgcactgtttcaaacgcccgatccctcgctctttctcctacctcatctgggacatcatcatatcctcctgcttctactacgtcgccaccacttacttccctcccctccctcaccctctctcctacttcgcctggcctctctactgggcctgccaagggtgcgtcctaaccggcgtctgggtcatagcccacgagtgcggccaccacgccttcagcgactac

SEQ ID NO: 33598 - DNA, 332 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33599 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33600 - DNA, 423 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactctcgacttcgctgctacccaaggttgccccacgagtacatcgagctgatcgagatcgcccggaacagcacccaagagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33601 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtcccctgcgagacaccacccttcactctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33602 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcggggtcatagcccacgagtgcggccaccacgccttcagcgactac

SEQ ID NO: 33603 - DNA, 277 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagacatcatcatagcctcctacttctactacgtcgccaccacttacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 33604 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 33605 - DNA, 443 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggtcataatgtttttggtacaaccgatttagctttatgctctgaggcttagaccgagatagggttgagtgttgttccagtttggaacaagagtccactatttaaagcaatcccaccgcactgtttcaaacgctcgatccctcgctctttctcctacctcatctgggacatcatcatagcctcctgcttctactacgtcgccaccacgtacttccctctccgccctcaccctctctcctacttcgcctggcctctctactgggcctgccaagggtgcgtccgaaccggcgtcggggtcatagcccacgagtgcggccaccacgccttcagcgactac

SEQ ID NO: 33606 - DNA, 350 bp, Artificial
  Mutation in BnaC.FAD2.a introduced by TALE nuclease pair BnFAD2_T03
caggatccatgggtgcaggtggaagaatgcaagtctctcctccctcccgctcccccgaaaccaaaaccctcaaacgcgtcccctgcgagacaccacccttcactctagacctcaagaaagcaatcccacctcactgcttcaaacgctcgatccctcgctctttctccttcctcatctgggacatcatcatagcctcctgcttctactacgtcgccaccacttacttccctctcctccctcaccctctctcctacttcgcctggcctctctactgggcctgccaatggtgcgtcctaaccggcttcttggtcatagcccacgagtgcggccaccacgccttcagcgactac

SEQ ID NO: 33607 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgattcctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33608 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagcctgaaaccgacaccctcaagcgcgtaccctgcgagacaccgcccttcactgtagaactcaagaaagcaatcccaccgcactgtttcaaacgctcgatccctccctctttctcctacctcatctgggacatcatcatcgcctccttcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33609 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgacac

SEQ ID NO: 33610 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgcctccagcgactac

SEQ ID NO: 33611 - DNA, 460 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgtctccagcggctgttgccggtgctgtgccaggcccacggcttgaccccccagcaggtggtggccatcgccagcaatggcggtggcaagcaggcgctggagacggtccagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33612 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctacttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33613 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33614 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccatcagcgactac

SEQ ID NO: 33615 - DNA, 347 bp, Artificial
  Mutation in BnaC.FAD2.a introduced by TALE nuclease pair BnFAD2_T03
caggatctatgggtgcagggggaagaatgcaagtgtctcctccctccaagaagactgaaaccgataccatcaagcgcgtaccttgcgagacaccgcccttcactgaactcaagaaagcaatcccaccgcactgtttcaaacgctcgatccctcgctctttctcctacctcatttgggacatcatcatagcctcctgcttctactacctcgccaccacttacttccctctcctccctcaccctctctcatacttcgcctaacctctctactgggcctgcctcgggtccgtcctaaccggcgtctgcttcatagcccacaagtgcggccaccacgccttcaacgactac

SEQ ID NO: 33616 - DNA, 408 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttggccaccacctgctccggggtcaagctggaggggtacaccttccaccactcgttgggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33617 - DNA, 433 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcggtggcaagcaggcgctggagacggtccagcggctgttgccggtgctttgccaggcccacggcttggccccccagcaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33618 - DNA, 350 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatagcccacgagtgcggccaccacgccttcagcgactac

SEQ ID NO: 33619 - DNA, 346 bp, Artificial
  Mutation in BnaC.FAD2.a introduced by TALE nuclease pair BnFAD2_T03
caggatccatgggtgcaggtggaagaatgcaagtgtcaccccccataaaaaaggctgaaaccgacaccataaaccgtgtaccctgcgagacaccgcccttcactgactcaaaaaagcaatcccaccgcactgtttcacacgctcgatccctcgctctttctcctaccacatctgggacatcatcatagccgcctgcttctactacgtcgccaccacttacgtccctctcctccctcaccctctctcctacttcccctagcctctctactgggcctgccaagagtgcttccgaaccggcgtcggggtcattgcctgcgagtgcggccaccgcgccatgagcgactac

SEQ ID NO: 33620 - DNA, 451 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaatggcggtggcaagcaggcgctggagacggtccagcggctgttgccggtgctgtgccaggcccacggcttgaccccggagcaggtggtggccaccgccatggagaactcaagaaagcaatcccaccgcactgtttcaaacgctcgatccctcgctctttctcctacctcatctgggacatcatcatagcccctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33621 - DNA, 357 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtccgatctagaactcaagaaagcactcccaccgcactgtttcacacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33622 - DNA, 416 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttagttaccggataaggcgcagcggtcgggctgaacgggggtgtagatggcgccgtcgggcttcgaaagaactcaagaaagcaatcccaccgcactgtttcaaacgctcgatccctcgctctttctcctacctcatctgggacatcatcatagcctcctgcttctactacgtcgccaccactcacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33623 - DNA, 327 bp, Artificial
  Mutation in BnaC.FAD2.a introduced by TALE nuclease pair BnFAD2_T03
caggatccatgggtgcaggtggaagaatgcaagtgtctcctccctccaagaagtctgaaacagacaccatcaagcgcgtcccctgcgagacatcaagcaatcccaccgcactgtttcaaacgctcgatccatcgctctttctcctacctcatctgggacatcatcatagcctcctgcttctactacgtcgccaccacttacttccctatcctccctcaccctctctcctacttcgcctggcctctctactgggcctgccaagggtgcgtccaaaccggcgtctgggtcatagcccacgagtgcggccaccacgccttcagcgactac

SEQ ID NO: 33624 - DNA, 337 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33625 - DNA, 410 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggttcagcctggtcagctgggccttgtagttgcccttgaagtggccggacacgaacaggagaactcaagaaagcaatcccaccgcactgtttcaaacgctcgatccctcgctctttctcctacctcatctgggacatcatcatagcctcctgcttctactacgtcgccacaacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33626 - DNA, 319 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33627 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggatgcgtcctaaccggcgtctgggtcatagcccacgagtgcggccaccacgccttcagcgactac

SEQ ID NO: 33628 - DNA, 347 bp, Artificial
  Mutation in BnaC.FAD2.a introduced by TALE nuclease pair BnFAD2_T03
caggatccatgggtgcaggtggaagaatgcaagtgtcccctccccccaagaagcctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgctaaggatgcgtcctaaccggcgtctgggtcatagccctcgggtgcggccaccacgccttcagcgactac

SEQ ID NO: 33629 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaaacgcgtaccctgcgagacaccgcccttcactgtagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcatgccaagggtgcgtcctaaccggcgtctgggtcatagcccacgagtgcggccaccacgccttcagcgactac

SEQ ID NO: 33630 - DNA, 308 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 33631 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccctccactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaaccggcgtctgggtcatagcccacgagtgcggccaccacgccttcagcgactac

SEQ ID NO: 33632 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagcccgaaaccgacaccatcaagcgcgtaccctgcgagacaccgccctccactgtctcaaacgctcgatcccccgttcctcctcctacctcatctgggacatcaccacagcctcctgcttctactacatcgccaccacctacttccctctcctctctcaccctctctcctacctcgcctgacccctctactgggcctgccaaggctgcgtccgaaccggcgtcggggtcatagcccacgagtgcggccaccacgccttcagcgactac

SEQ ID NO: 33633 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacaactcaagaaagtaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33634 - DNA, 316 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 33635 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggtccctctactgggcctgccaaggctgcgtcctaaccggcgtctgggtcatagcccacgagtgcggccaccacgccttcagcgactac

SEQ ID NO: 33636 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 33637 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 33638 - DNA, 347 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgcctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33639 - DNA, 319 bp, Artificial
  Mutation in BnaC.FAD2.a introduced by TALE nuclease pair BnFAD2_T03
caggatccatgggtgcaggtgaaagaatgcaagtgtctcctccctccaagaagtctgaaaccgacaccatcaagcgcgtaccctgcgagacaccacccttcactgtttcaaacgctcgatccctcgctctttcttctacctcatctgggacatcatcatagcctcctgcttctactacgtcgccaccacttacttccctctcctccctcaccctctctcctacttcgcctggcctctctactgggcctgccaagggtgcgtcctaacgggcctcggggtcatcgcccacgaatgcggccaccacgccttcagcgactac

SEQ ID NO: 33640 - DNA, 277 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgggacatcatcatagcctcctgcttctactacgtcgccaccacttacttccctctcctccctcaccctctctcctacttcgcctggcctctctactgggcctgccgagggtgcgtcctaaccggcgtctgggtcatagcccacgagtgcggccaccacgccttcagcgactac

SEQ ID NO: 33641 - DNA, 339 bp, Artificial
  Mutation in BnaC.FAD2.a introduced by TALE nuclease pair BnFAD2_T03
cggatccatgggtgcaggtggaagaatgcaagtgtctcctccctccaagaagtctgaaaccgacaccatcaagcgcgtaccctgcgagacaccgccctactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcggggtcatagcccacgagtgcggccaccacgccttcagcgactac

SEQ ID NO: 33642 - DNA, 433 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcggtggcaagcaggcgctggagacggtccagcggctgttgccggtgctgtgccagtcccacggcctgaccccccagcaggagaactcaagaaagcaatcccaccgcactgtttcaaacgctcgatccctcgctctttctcctacctcatctgggacatcatcatagcctcctgcttctactacgtcgccaccacttacttccctctcctccctcaccatctctcctacttcgcctggcctctctactgggcctgccaagggtgcgtcctaaccggcgtctgggtcatagcccacgagtgcggccaccacgccttcagcgactac

SEQ ID NO: 33643 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtacactgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33644 - DNA, 349 bp, Artificial
  Mutation in BnaC.FAD2.a introduced by TALE nuclease pair BnFAD2_T03
caggatccatgggtgcaggtggaagaatgcaagtgtctcctcactccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33645 - DNA, 308 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctcttctgggcctgccaagggtgcgtcctaaccggcgtctgggtcatagcccacgagtgcggccaccacgccttcagcgactac

SEQ ID NO: 33646 - DNA, 351 bp, Artificial
  Mutation in BnaC.FAD2.a introduced by TALE nuclease pair BnFAD2_T03
caggatccatgggtgcaggtggaagaatgcaagtctctcctccctcccgctcccccggaaccaacaccctcaaacgcgtcccctgcgagacaccgcccttcactgtcggaactcaagaaagcaatcccaccgcactgtttgaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33647 - DNA, 351 bp, Artificial
  Mutation in BnaC.FAD2.a introduced by TALE nuclease pair BnFAD2_T03
caggatccatgggtgcaggttgaagaatgcaagtgtctcctccctcccagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 33648 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgcctggcctctctactgggcctgccaagggtgcgtcctaaccggcggctgggtcatagcccacgagtgcggccaccacgccttcaccgactac

SEQ ID NO: 33649 - DNA, 347 bp, Artificial
  Mutation in BnaC.FAD2.a introduced by TALE nuclease pair BnFAD2_T03
caggatccatgggtgcaggtggaagaatgcaagtgtcccctccaagaagtctgaaaccgacaccatcaagcgcgtaccctgcgagacaccgcccttcactgtaagaactcaagaaagcaatcccaccgcactgtttcaaacgcccgatccctcgctctttctcctacctcatctgggacatcatcatagcctcctgcttctactacgtcgccaccacttacttccctctcctccctcaccctctctcctccttcgcctggcctctctactgggcctgccaaggctgcgtcctaacgggcctctgggtcatagcccacgagtgcggccaccacgccttcagcgactac

SEQ ID NO: 33650 - DNA, 343 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 33651 - DNA, 331 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33652 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaagaactcaagaaagcaatcccaccgcactgtttcaaacgctcgatccctcgctcttcctcctacctcatctgggacatcatcatagcctcctgcttctactacgtcgccaccacttacttccctctcctccctcaccctctctcctacttcgactggcctctctactgggcctgccatgggtgcgtcctaacgggcctctgggtcatcgcccacgagtgcggccaccacgccttcagcgactac

SEQ ID NO: 33653 - DNA, 366 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgatggccaccacctgctgaggggtcaagccgaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 33654 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctgacccctctactgggcctgccaaggctgcgtcctaacgggcctctgggtcatagcccacgagtgcggccaccacgccttcagcgactac

SEQ ID NO: 33655 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 33656 - DNA, 347 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33657 - DNA, 344 bp, Artificial
  Mutation in BnaC.FAD2.a introduced by TALE nuclease pair BnFAD2_T03
caggatccatgggtgcaggtggcagaatgcaagtctctcctccctccagctcccccgaacccaaaaccctcaaacgcgtcccctgcgagacaccaccattcactctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33658 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagcgtgcgtcctaaccggcgtcggggtcatagcccacgagtgcggccaccacgccttcagcgactac

SEQ ID NO: 33659 - DNA, 356 bp, Artificial
  Mutation in BnaC.FAD2.a introduced by TALE nuclease pair BnFAD2_T03
caggatccatgggtgcaggtggaagaatgcaagtgtctcctccctcccagaagtctgaaaccgacaccatcaagcgcgtaccctgcgcgacaccgcccttcactttgctccaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacatcgccgggcctctcgactgggccggccaagggtgcgtcctaaccggcgtctgggtcatagcccacgattgcggccaccacgccgtcaacgactac

SEQ ID NO: 33660 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgctcaagaaaacaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtacggccaccacgccttcagcgactac

SEQ ID NO: 33661 - DNA, 352 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgagtaccctgcgagacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33662 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 33663 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatccccccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33664 - DNA, 316 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 33665 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33666 - DNA, 350 bp, Artificial
  Mutation in BnaC.FAD2.a introduced by TALE nuclease pair BnFAD2_T03
caggatccatgggtgcaggtggcagaatgcaagtgtctcctccctccaaaaagtctgaaaccgacaccatcaagcgcgtaccctgcgagacaccgcccttcactgtagaactcaagaaagcaatcccaccgtactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaatcggcgtctgggtcatagcccacgagtgcggccaccacgccttcagcgactac

SEQ ID NO: 33667 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 33668 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgagtgcggccaccacgccttcagcgactac

SEQ ID NO: 33669 - DNA, 391 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtacggtccagcggctgttgccggtgctgtgccaggcccacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33670 - DNA, 349 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtcggcggagaactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 33671 - DNA, 295 bp, Artificial
  Mutation in BnaC.FAD2.a introduced by TALE nuclease pair BnFAD2_T03
caggatccatgggtgcaggtggaagaatgcaagtctctcatccctccaggtagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcttggtcatagcccacgagtgcggccaccacgccttcagcgactac

SEQ ID NO: 33672 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacggggcctgccaagggtgcgtcctaaccggcgtcggggtcatagcccacgagtgcggccaccacgccttcagcgactac

SEQ ID NO: 33673 - DNA, 356 bp, Artificial
  Mutation in BnaC.FAD2.a introduced by TALE nuclease pair BnFAD2_T03
caggatccatgggtgcaggtggaagaatgcaagtctctcctccctccaagaagcctgaaaccgacaccatcaagcgcgtaccctgcgagacaccgcccttcactgtcggcgaagaactcaagaaagcaatcccaccgcactgtttcaaacgctcgatccctcgctctttctcctacctcatctgggacatcatcatagcctcctgcttctactacgtcgccaccacttacttccctcccgtcccccaccctctcccttacctcgcctggcccctctactgggccggccaaggctgcgtcctaacgggcctcggggtcatagcccacgagtgcggccaccacgccttcagcgactac

SEQ ID NO: 33674 - DNA, 345 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33675 - DNA, 428 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtcggtgctgtgccaggcccacggcttgaccccccagcaggtggtggccatcgccagcaataatggcggcaagcaggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 33676 - DNA, 349 bp, Artificial
  Mutation in BnaC.FAD2.a introduced by TALE nuclease pair BnFAD2_T03
caggatccattggtgcaggtggaagaatgcaagtgtctcctccctccaagaagtctgaaaccgacaccatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 33677 - DNA, 356 bp, Artificial
  Mutation in BnaC.FAD2.a introduced by TALE nuclease pair BnFAD2_T03
caggatccatgggtgcaggtggaagaatgcaagtatctcctccctccaagaagtctgaaaccgacaccatcaagcgcgtaccctgcgagacaccgcccttcactttgctccaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33678 - DNA, 319 bp, Artificial
  Mutation in BnaC.FAD2.a introduced by TALE nuclease pair BnFAD2_T03
caggatccatgggtgcaggtggaagaatgcaagtgtctccttcctccaagaagtctgaaaccgacaccatcaagcgcgtaccctgcgagacaccacccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggccggccaagagtgcgtccgaaccggcgtcggggtcattgcccacaagtgcggccaccgcgccatcagcaactac

SEQ ID NO: 33679 - DNA, 350 bp, Artificial
  Mutation in BnaC.FAD2.a introduced by TALE nuclease pair BnFAD2_T03
caggatccatgggtgcaggtggaagaatgcaagtgtctcctccctccagctcccccggaaccaacaccctcaaacgcgtcccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 33680 - DNA, 349 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 33681 - DNA, 341 bp, Artificial
  Mutation in BnaC.FAD2.a introduced by TALE nuclease pair BnFAD2_T03
caggatccatgggtgcaggtggaagaatgcaagtgcatcctccctccaagaagtctgaacccgacaccatcaagcgcgtaccctgcgagacaccgcccgaactcaagaaagcaatctcaccgcactgtttcaaacgctcgatccctcgctctttctcctacctcatctgggacatcatcatagcctcctgcttctactacgtcgccaccacttacttccctctcctccctcaccctctctcccacttcgcctggcctctctactgggcctgccaagggtgcgtcctaaccggcgtctgggtcatagcccacgagtgctgccaccacgccttcagcgactac

SEQ ID NO: 33682 - DNA, 295 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcgctctttctcctacctcatctgggacatcatcatagcctcctgcttctactacgtcgccaccacttacttccctctcctccctcaccctctctcctacttcgccttgcctctctactgggcctgccaagggtgcgtcctaaccggcgtctgggtcatagcccacgagtgcggccaccacgccttcagcgactac

SEQ ID NO: 33683 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgtgtcctaacgggcctctgggtcatcgcccacgaatgcggccaccacgccttcagcgactac

SEQ ID NO: 33684 - DNA, 432 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctctccagcggctgttgccggtgctgtgccaggcccacggcttgatcccccagcaggtggtggccatcgccagcaataatggggagacctcaagaaagcaatcccacctcactgcttcaaacgctccatcccacgctccttctcctacctcatctcggacatcagcatagcctcctgcttctacgacgtcgccaccccttacttccctcccctccctcatcctctctcctacttcgcctggcctctctactgggcctgccaagggtgcgtcctaaccggcgtctgggtcatagcccacgagtgcggccaccacgccttcagcgactac

SEQ ID NO: 33685 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccaccgcactgtttcaaacgctcgatccctcgctctttctcctacctcatctgggacatcatcatagcctcctgcttctactacgccgccaccacttacttccctctccgccctcaccctctctcctacttcgcctggcctctctactgggcctgccaagggtgcgtcctaacgggcctctgggtcatagcccacgagtgcggccaccacgccttcagcgactac

SEQ ID NO: 33686 - DNA, 350 bp, Artificial
  Mutation in BnaC.FAD2.a introduced by TALE nuclease pair BnFAD2_T03
caggatccatgggtgcaggtggaagaatgcaagtgtctcctccctcccagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33687 - DNA, 325 bp, Artificial
  Mutation in BnaC.FAD2.a introduced by TALE nuclease pair BnFAD2_T03
caggatccatgggtgcaggtggaagaatgcaagtctctccaccctccaagaagtctgaaaccgacaccatcaagcgcgtatagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33688 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctgacccctctactgggcctgccaaggctgcgtcctaacgggcctctgggtcatagcccacgagtgcggccaccacgccttcagcgactac

SEQ ID NO: 33689 - DNA, 342 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 33690 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcctggcctctctactgggcctgccaagggtgcgtcctaaccggcgtcggggtcatagcccacgagtgcggccaccacgccttcagcgactac

SEQ ID NO: 33691 - DNA, 397 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttggcggcaacagccgctggaccgtctccagcgcctgcttgccggtggagaactcaagaaagcaatcccaccgcactgtttcaaacgctcgatccctcgctctttctcctacctcatctgggacatcatcatagcctcctgcttctactacgtcgccaccccttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33692 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgcaaccgacaacatcaagcgcgtcccctgcgagacaccgcccttcactgtagaactcaagaaagcaatcccaccgcactgtttccaacgctcgatccctcgctctttctcctccctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33693 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccttccctctctcctgtgcctgcccgtgttgcgtccttaccggcgtctgcgtcatagcccacgagtgcggccaccacgccttcagcgactaa

SEQ ID NO: 33694 - DNA, 295 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcgctctttctcctacatcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33695 - DNA, 351 bp, Artificial
  Mutation in BnaC.FAD2.a introduced by TALE nuclease pair BnFAD2_T03
caggatccattggtgcaggtggaagaatgcaagtgtctcctccctccaagaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 33696 - DNA, 347 bp, Artificial
  Mutation in BnaC.FAD2.a introduced by TALE nuclease pair BnFAD2_T03
caggatccatgggtgcaggtggaagaatgcaagtgtcccctccctccaagaagtctgaaaccgacaccatcaagcacgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcttggtcatagcccacgagtgcggccaccacgccttcagcgactac

SEQ ID NO: 33697 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatcccccgctcttcctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33698 - DNA, 348 bp, Artificial
  Mutation in BnaC.FAD2.a introduced by TALE nuclease pair BnFAD2_T03
caggatccatgggcgcaggtggaagaatgcaagtctctcctccctccagctcccccgaaaccaaaaccctcaaacgcgtcccctgcgagacaccacccttcactctacctcaaaaaagcaatcccaccgcactgtttcaaacgctcgatccctcgctctttctcctacctcatctgggacatcatcatagcctcctgctgctactacgtcgccaccacttacttccctctcctccctcaccctctctcctacgtcgcctggcctctctacggggcctgccaaggctgcgtcctaacgggcctctgggtcatcgcccacgaatgcggccaccacgccttcagcgactac

SEQ ID NO: 33699 - DNA, 382 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgatagttgagtcgatacttcggcgatcaccgctgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33700 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacaaatgcggccaccacgccttcagcgactac

SEQ ID NO: 33701 - DNA, 413 bp, Artificial
  Mutation in BnaC.FAD2.a introduced by TALE nuclease pair BnFAD2_T03
caggatccatgggtgcaggtggaagaatgcaagtgtctcctccctcccagaagtctgaaaccgacaccatcaagcgcgtaccctgcgagacaccgcccttcactgtcggccatcgccagcaatggcggtggcaagcaggcgctggagacggtccagcggctgttgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33702 - DNA, 350 bp, Artificial
  Mutation in BnaC.FAD2.a introduced by TALE nuclease pair BnFAD2_T03
caggatccatgggtgcaggtggaagaatgcaagtgcctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttctgcgactac

SEQ ID NO: 33703 - DNA, 350 bp, Artificial
  Mutation in BnaC.FAD2.a introduced by TALE nuclease pair BnFAD2_T03
caggatccatgggtgcaggtggaagaatgcaagtatctactccctcaaagaagtctgaaaccgacaccatcaagcgcgtaccctgcgagacaccgcccttcactgtagaactcaagaaagcaatctcaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33704 - DNA, 333 bp, Artificial
  Mutation in BnaC.FAD2.a introduced by TALE nuclease pair BnFAD2_T03
caggatccatgggtgcaggtggaagaatgcaagtgtctcctccctccaaaaagcctgaaaccgagcccccgatttagagcttcacggggagaactcaagaaagcaatcccaccgcactgattcaaacgcccgatccctcgctctttctcctacctcatctgggacatcatcatagcctcctgcttctactacgtcgccaccccttacttccctctccccccccaccctctcccttacctcgcctggcccctctactgggcctgccaagggtgcgtcctaacgggcctctgggtcatcgcccacgaatgcggccaccacgccttcagcgactac

SEQ ID NO: 33705 - DNA, 401 bp, Artificial
  Mutation in BnaC.FAD2.a introduced by TALE nuclease pair BnFAD2_T03
caggatccatgggtgcaggtggcagaatgcaagtgtctaccccctccaagaagtctgaaaccgacaccatcaagcgcgtaccctgcgagacaccgcccttcactgtgggccttgtagttgcccttgaagtggccggacacgaacaggaacttgaactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcttcgcctggcctctctactgggcctgccaagagtgcttcctaaccggcgtcggggtcatagcccacgtgtgcgtcctccacgccttcagcgactac

SEQ ID NO: 33706 - DNA, 295 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 33707 - DNA, 349 bp, Artificial
  Mutation in BnaC.FAD2.a introduced by TALE nuclease pair BnFAD2_T03
caggatccatgggtgcaggtggaagaatgcaagtgtctcctccctcccagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcgtccaccacgccttcagcgactac

SEQ ID NO: 33708 - DNA, 348 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33709 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtacggccaccacgccttcagcgactac

SEQ ID NO: 33710 - DNA, 411 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccctcaagcgcgtaccctgcgagacaccgcccttcactgtgtacgtgccccacgagtacatcgagctgatcgagatcgcccggaacagcacccaggaccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33711 - DNA, 344 bp, Artificial
  Mutation in BnaC.FAD2.a introduced by TALE nuclease pair BnFAD2_T03
caggatccatgagtgcaggtggcagaatgcaagtgactaatccctcaaagaagtctgaaaccgacaccatcaagcgcgtaccctgcgagacaccgcccttcactctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 33712 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacctcatcatagcctcctgcttctactacgtcgccaccacttacttccctctcctccctcaccctctctcctacttcgcctggcctctctacggggcctgccaagggtgcgtcctaaccggcgtctgggtcatagcccacgagtgcggccaccacgccttcagcgactac

SEQ ID NO: 33713 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcttggtcatagcccacgagtgcggccaccacgccttcagcgactac

SEQ ID NO: 33714 - DNA, 339 bp, Artificial
  Mutation in BnaC.FAD2.a introduced by TALE nuclease pair BnFAD2_T03
caggatccatgtgtgcaggtggaagaatgcaagtctctcctccctccagctcccccgaaaccaaaaccctcaaacgcgtcccctgcgagacaccaagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacggggccggccaaggcggcgtcctaacgggcctctgggccatggcccgcgagtgcggccaccacgccttcagcgactac

SEQ ID NO: 33715 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggctaccacgccttcagcgactac

SEQ ID NO: 33716 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctccagcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33717 - DNA, 411 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaggtcttgaccccggagcaggtggtggccatcgccagccacgatggcggcaagcaggcgctggagaagaactcaagaaagcaatcccaccgcactgtttcaaacgctcgatccctcgctctttctcctacctcatctgggacatcatcatagcctcctgcttctactacgtcgccaccacttacttccctctcctccctcaccctttctcctacttcgcctggcctctctactgggcctgccaagggtgcgtcctaacgggcctctgggtcatcgcccacgaatgcggccaccacgccttcagcgactac

SEQ ID NO: 33718 - DNA, 325 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33719 - DNA, 348 bp, Artificial
  Mutation in BnaC.FAD2.a introduced by TALE nuclease pair BnFAD2_T03
caggatccatgggtgcaggaggaagaatgcaagtctctcctccctccaaaaagtctgaaaccgacaccatcaagcgcgtaccctgcgagacaccgcccttcactgtaactcaagaaagcaatccaaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggacatagcccacgagggcggccaccacgccttcagcgactac

SEQ ID NO: 33720 - DNA, 352 bp, Artificial
  Mutation in BnaC.FAD2.a introduced by TALE nuclease pair BnFAD2_T03
caggatccatgggtgcaggtggaagaatgcaagtctctcctccctccagctcccccggaaccgacaccatcaagcgcgtaccctgcgagacaccgcccttcactgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 33721 - DNA, 467 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactacggatggccttctgcttagtttgatgcctggcagtttatggcgggcagggggggggggccgattcaatgaagacaaacgacatagtgaataaacgcggaatgcaattttgggaatggcagaactcaagaaagcaatcccaccgcactgtttcaaacccccgatccctccctctttctcctacctcatctgggacatcatcatagcctcctgcttctactacgtcgccaccacttacttccctctcctccctcaccctctctcctacttcgcctggcctctctactgggcctgccaagggtgcgtcctaaccggggtctgggtcatagccctcgagtgcggtcaccacgccttcatcgactac

SEQ ID NO: 33722 - DNA, 357 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttgcctggcctctctactgggcctgccaagggtgcgtcctaaccggcgtctgggtcatagcccacgagtgcggccaccacgccttcagcgactac

SEQ ID NO: 33723 - DNA, 341 bp, Artificial
  Mutation in BnaC.FAD2.a introduced by TALE nuclease pair BnFAD2_T03
caggatccatgggtgcaggtggcagaatgcaagtctctcctccctccagctcccccgaaaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33724 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccaccgcactgtttcaaacgctcgatacctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 33725 - DNA, 325 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtatagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 33726 - DNA, 434 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcccagcaggtggtggccatcgccagcaatggcggtggcaagcaggcgctggagacggtccagcggctgttgccggtgctgtgccagaactcaagaaagcaatcccaccgcactgtttcaaacgctcgatccctcgctctttctcctacctcacctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33727 - DNA, 343 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaactcaagaaagcaatcccaccgcactgtttcaaacgctcgatccctcgctctttctcctacctcatctgggacatcatcatagcctcctgcttctactacgtcgccaccacttacttccttctcctccctcaccctctctcctacttcgcctggcctctctactgggcctgccaagggtgcgtcctaaccggcgtctgggtcatagcccacgagtgcggccaccacgccttcagcgactac

SEQ ID NO: 33728 - DNA, 349 bp, Artificial
  Mutation in BnaC.FAD2.a introduced by TALE nuclease pair BnFAD2_T03
caggatccatgggtgcaggtggaagaatgcaagtgcctacccccaccaagaagtctgaaaccgacaccatcaagcgcgtaccctgcgagacaccgcccttcactaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcggggtcatagcccgcgagtgcggccaccacgccttcagcgactac

SEQ ID NO: 33729 - DNA, 333 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccatgggtgcgtcctaaccggcgtctgggtcatagcccacgagtgcggccaccacgccttcagcgactac

SEQ ID NO: 33730 - DNA, 336 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcggcgactac

SEQ ID NO: 33731 - DNA, 277 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 33732 - DNA, 374 bp, Artificial
  Mutation in BnaC.FAD2.a introduced by TALE nuclease pair BnFAD2_T03
caggatccatgggtgcaggtcgcagaatgcaagtgtctcctccctccaagaagtctgaaaccgacaccatcaagcgcgtaccctgcgagacaccgcccttcactgttttgccagcgcctaatgcgccgggagaactcaagaaagcaatcccaccgcactgtttcaaacgctcgatccctcgctctttctcctacctcatctgggacatcatcatagcctcctgcttctactacgtcgtcaccacttacttccctctcctccctcaccctctctcctacttcgcctggcctctctactgggcctgccaagggtgcgtcctaaccggcggctgggtcatagcccacgagtgcggccaccacgccttcagcgactac

SEQ ID NO: 33733 - DNA, 327 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacatcaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33734 - DNA, 346 bp, Artificial
  Mutation in BnaC.FAD2.a introduced by TALE nuclease pair BnFAD2_T03
caggatccatgggtgcaggtggaagaatgcaagtttcttctccctccaagaagtctgaaacctacaccatcaagcgcgtaccctgctagacaccgccctacaagaactcaagaaagcaatcccaccgcactgtttcaaatgctcgatccctcgctctttcgcctacctcatctgggacatcatcatagcctcctgcttctactacgtcgccaccacttacttccctctcctccctcaccctctctccttcgtcgcctggcctctctactgggcctgccaagggtgcgtcctaaccggcgtctgggtcatagcccacgagtgcggccaccacgccttcagcgactac

SEQ ID NO: 33735 - DNA, 349 bp, Artificial
  Mutation in BnaC.FAD2.a introduced by TALE nuclease pair BnFAD2_T03
caggatccatgggtgcaggtggaagaatgcaagtgtctactccctccaagaagtctgaaacctacaccatcaagcgcgtaccctgcgagacaccgcccttcactgttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33736 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 33737 - DNA, 349 bp, Artificial
  Mutation in BnaC.FAD2.a introduced by TALE nuclease pair BnFAD2_T03
caggatccatgggtgcaggtggcagaatgcaagtctctgctccctccagctcccccgaaaccaaaaccctcaaacgcgtcccctgcgagacaccacccttcactcagacctcaagaaagcaatcccaccgcactgtttcaaacgctcgatccctcgctctttctcctacctcatctggaacatcatcatagcctcctgcttctactacgtcgccaccacttacttccctctcctccctcaccctctctcctacttcccctagcctctctactgggcctgccaagggtgcgtcctaaccggcgtctgggtcatagcccacgagtgcggccaccacgcctgcagcgactac

SEQ ID NO: 33738 - DNA, 304 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcaatcccaccgcactgtttcaaacgctcgatccctcgctctttctcctacctcatctgggacatcatcatagcctcctgcttctactacgtcgccaccacttacttccctctcctccctcaccctctctcccacttcgcctggcctctctactgggcctgccaagggtgcgtcctaaccggcgtctgggtcatagcccacgagtgcggccaccacgccttcagcgactac

SEQ ID NO: 33739 - DNA, 349 bp, Artificial
  Mutation in BnaC.FAD2.a introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactgagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcatctgggtcatagcccacgagtgcggccaccacgccttcagcgactac

SEQ ID NO: 33740 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgtgtcctaaccggcgtctgggtcatagcccacgagtgcggccaccacgccttcagcgactac

SEQ ID NO: 33741 - DNA, 338 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaaaacaatcccaccgcactgtttcaaacgctcgatccctcgctctttctcctacctcatctgggacatcatcatagcctcctgcttctactacgtcgccaccacttacttccctctcctccctcaccctctctcctacttcgcccggcctctctactgggcctgccaagggtgcgtcctaaccggcgtctgggtcatagcccacgagtgcggccaccacgccttcagcgactac

SEQ ID NO: 33742 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctacttggcctgccaaggctgcgtcctaacgggcctctgggtcatcgcccacgaatgcggccaccacgccttcagcgactac

SEQ ID NO: 33743 - DNA, 438 bp, Artificial
  Mutation in BnaC.FAD2.a introduced by TALE nuclease pair BnFAD2_T03
caggatccatgggtgcaggtggaagaatgcaagtgtctactccctccaaaaagtctgaaaccgacaccatcaagcgcgtaccctgcgagacaccgcccttcactgtgtgccacgctgagagccagcagcaaatgaaaaatctaaagggggtcaagccgtgggcctggcacagcaccggcaacagccgctggacaagaactcaagaaagcaatcccaccgcactgtttcaaacgctcgatccctcgctctttctcctacctcatctgggacatcatcatagcctcctgcttctactacgtcgccaccacctacttccctcccctccctcaccctctctcctacttcgcctggcctctctactgggcctgccaagggtgcgtcctaaccggcgtctgggtcatagcccacgagtgcggccaccacgccttcagcgactac

SEQ ID NO: 33744 - DNA, 348 bp, Artificial
  Mutation in BnaC.FAD2.a introduced by TALE nuclease pair BnFAD2_T03
caggatccatgggtgcaggtggaagaatgcaagtgcctcctccctccaagaagtctgaaaccgacaccatcaagcgcgtaccctgcgagacaccgcccttcactgttactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 33745 - DNA, 334 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 33746 - DNA, 421 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactatttgatgcctggcagttccctactctcgccagcaataatggtggcaagcaggcgctggagacggtccagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33747 - DNA, 305 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33748 - DNA, 371 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccatcaagcgcgtaccctgcgagacaccgcccttcactgtcggtccagcggctgttgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaaccggcgtctgggtcatagcccacgagtgcggccaccacgccttcagcgactac

SEQ ID NO: 33749 - DNA, 399 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccaacaagcgcgtaccctgcgagacaccgcccttcactgtttgggggatcctatcagccgttcccagctggtgaagtccgagctggaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33750 - DNA, 314 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaaactcaagaaagcaatctcaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 33751 - DNA, 370 bp, Artificial
  Mutation in BnaC.FAD2.a introduced by TALE nuclease pair BnFAD2_T03
caggatccatgggtgcaggtggaagaatgcaagtgtctcctccctccaaaaagcctgaaaccgacaccatcaagcgcgtaccctgcgagacaccgcccttcaatggcaagcaggccctggagacggagaactcaagaaagcaatcccaccacactgtttcaaacacccgatccctcgctctttcacctacctcatctgggacatcatcatagcctcctgcttctactacgtctccaccacttacttccctcccctccctccccctctctcccccttcccctggcctctctactgggcctgccaagggtgcgtcctaaccggcgtctgggtcatagcccacgagtgcggccaccacgccttcagcgactac

SEQ ID NO: 33752 - DNA, 348 bp, Artificial
  Mutation in BnaC.FAD2.a introduced by TALE nuclease pair BnFAD2_T03
caggatccatgggtgcaggtggaagaatgcaagtctctactccctccagctcccccggaaccaacaccctcaaacgcgtcccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcggcctaacgggcctctgggtcatcgcccacgaatgcggccaccacgccttcagcgactac

SEQ ID NO: 33753 - DNA, 412 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgttcaggagagcgttcaccgacaaacaacagataaaacgaaaggcccagtcttccgactgagccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 33754 - DNA, 349 bp, Artificial
  Mutation in BnaC.FAD2.a introduced by TALE nuclease pair BnFAD2_T03
caggatccatgggtgcaggtagaagaatgcaagtgtctcctccctcccagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgctttcagcgactac

SEQ ID NO: 33755 - DNA, 343 bp, Artificial
  Mutation in BnaC.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactgtaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33756 - DNA, 319 bp, Artificial
  Mutation in BnaC.FAD2.a introduced by TALE nuclease pair BnFAD2_T03
caggatccatgggtgcaggtggtagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33757 - DNA, 331 bp, Artificial
  Mutation in BnaC.FAD2.a introduced by TALE nuclease pair BnFAD2_T03
caggatccatgggtgcaggtcgcagaatgcaagtacatcctccctccagctcccccggaaccaacaccctcaaacgcgtcccctgcgagacctcaagaaagcaatcccacctcactgcttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggccgctgggtcatagcccacgagtggggccaccacgccttcagcgactac

SEQ ID NO: 33758 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33759 - DNA, 277 bp, Artificial
  Mutation in BnaC.FAD2.a introduced by TALE nuclease pair BnFAD2_T03
caggatccatgggtgcaggtgggagaatgcaagtgtttcctccctcccagaagtctgaaaccgacaccatcaagcgcgtaccctgcgagacaccgcccttcactgtcgatcgagcgtttgaaacagtgcggtgggattgctttcttgagttctccctctcctccctcaccctctctcctacttcgcctggcctctctactgggcctgccaagggtgcgtcctaaccggcgtctgggtcatagcccacgagtgcggccaccacgccttcagcgactcc

SEQ ID NO: 33760 - DNA, 350 bp, Artificial
  Mutation in BnaC.FAD2.a introduced by TALE nuclease pair BnFAD2_T03
caggatccatgggtgcagggggcagaatgcaagtgtctcctccacctcagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactcggcctgccaagggtgcgtcctaacctgcgtctgggtcatagcccacgagtgcgtccaccacgccttcagcgactac

SEQ ID NO: 33761 - DNA, 347 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33762 - DNA, 381 bp, Artificial
  Mutation in BnaC.FAD2.a introduced by TALE nuclease pair BnFAD2_T03
caggatccatgggtgcaggtggaagaatgcaagtctctcctccctccaaaaagcctgaaaccgacaccatcaagcgcgtaccctgcgagacaccgcccttcactgtcgaggcatttctgacctggctggtctagcggagaactcaagaaagcaatcccaccgcactgtttcaaacgctcgaaccctcgctctttctcctacctcatctgggacatcatcatagcctcctgcttctactacgtcgccaccacttacttccctcccccccctcaccctctctcctacttcgcctggcctctctactgggcctgccaagggtgcgtcctaaccggcgtctgggtcatagcccacgagtgcggccaccacgccttcagcgactac

SEQ ID NO: 33763 - DNA, 380 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcataccctgcgagacaccgcccttcatctagatccaatgatcatgagcggagaattaaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagtccacgagtgcggccaccacgccttcagcgactac

SEQ ID NO: 33764 - DNA, 350 bp, Artificial
  Mutation in BnaC.FAD2.a introduced by TALE nuclease pair BnFAD2_T03
caggatccatgggtgcaggtggcagaatgcaagtgtctcctccctccagctcccccgaaaccaaaaccctcaaacgcgtcccctgcgagacaccacccttcactcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgccgggcctctctactgggcctgccaaggcagcgtcctaacgggccgctgggtcatcgcccacgaatgcggccaccacgccttcagcgactac

SEQ ID NO: 33765 - DNA, 331 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctctgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33766 - DNA, 342 bp, Artificial
  Mutation in BnaC.FAD2.a introduced by TALE nuclease pair BnFAD2_T03
caggatccatgagtgcaggtggcagaatgcaagtgtctaccccctccaagaagtctgaaaccgacaccatcaagcgcgtaccctgcgagacaccgcccttcactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcggcctaaccggcgtcgggctcatagcccgcgagtgcggcctccacgccttcagcgactac

SEQ ID NO: 33767 - DNA, 441 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacagcaccggcaacagccgctggaccgtctccagcgcctgcttgccaccgccaagccgtgggcctggcacagcaccggcaacagccgctggacgacctcaagaaagcaatcccaccgcactgtttcaaacgctcgatccctcgctctttctcctccctcatctgggacatcatcatagcctcctgcttctactacgtcgccaccacttacttccctctcctccctcaccctctctcctacttcgcctggcccctctactgggcctgccaaggctgcgtcctaaccggcgtctgggtcatagcccacgagtgcggccaccacgccttcagcgactac

SEQ ID NO: 33768 - DNA, 344 bp, Artificial
  Mutation in BnaC.FAD2.a introduced by TALE nuclease pair BnFAD2_T03
caggatccatgggtgcaggtggaagaatgcaagtgtctcctcactccaagaagtctgaaaccgacaccatcaagcgcgtaccctgcgagacaccgcccttcacactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcccctggcccctctactgggcctgccaaggctgcgtcctaacgggcctctgggtcatagcccacgagtgcggccaccacgccttcagcgactac

SEQ ID NO: 33769 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaagaaagcaatcccaccgcactgtttcaaacgctcgatccctcgctctttctcctacctcatctgggacatcatcatagcctcctgcttctactacgtctccaccacttacttccctctcctccctcaccctctctcctacttcgcctggcctctctactgggcctgccaagggtgcgtcctaaccggcgtctgggtcatagcccacgagtgcggccagcacgccttcagcgactac

SEQ ID NO: 33770 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcacactctctcctacttcgcctggcctctctactgggcctgccaagggtgcgtcctaaccggcgtctgggtcatagcccacgagtgcggccaccacgccttcagcgactac

SEQ ID NO: 33771 - DNA, 334 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtatcccaccgcactgtttcaaacgctcgatccctcgctctttctcctacctcatctgggacatcatcatagcctcctgcttctactacgtcgccaccacttacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 33772 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcttctgggtcatagcccacgagtgcggccaccacgcctgcagcgactac

SEQ ID NO: 33773 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactactcaagaaagcaatcccaccgcactgtttcaaacgctcgatccctcgttctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33774 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgagtgcggccaccacgccttcagcgactac

SEQ ID NO: 33775 - DNA, 345 bp, Artificial
  Mutation in BnaC.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33776 - DNA, 343 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccatgctccttaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagtgactac

SEQ ID NO: 33777 - DNA, 351 bp, Artificial
  Mutation in BnaC.FAD2.a introduced by TALE nuclease pair BnFAD2_T03
caggatccatgggtgcaggtggaagaatgcaagtgtatcctccctccaagaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctaccaagggtgcgtcctaaccggcgtctgggtcatagcccacgagtgcggccaccacgccttcagcgactac

SEQ ID NO: 33778 - DNA, 416 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtccgactgagcctttcgttttatctgttgtttgtcggtgaacgctctcctgagtaggacaaatccggagaactcaagaaagcaatcccaccgcactgtttcaaacgctcgatccctcgctctttctcctacctcatctgggacatcatcatagcctcctgcttctactacgtcgccaccacttacttcccgctcctccctcaccctctctcctacttcgcctggcctctctactgggcctgccaagggtgcgtcctaaccggcgtctgggtcatagcccacgagtgcggccaccacgccttcagcgactac

SEQ ID NO: 33779 - DNA, 314 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctggggcatagcccacgagtgcggccaccacgccttcagcgactac

SEQ ID NO: 33780 - DNA, 350 bp, Artificial
  Mutation in BnaC.FAD2.a introduced by TALE nuclease pair BnFAD2_T03
caggatccatgggtgcaggtggaagaatgcaagtgtctcctccctcccagaagtctgaaaccgacaccatcaagcgcgtaccctgcgagacaccgcccttcactgttgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgctgccaccacgcctgcagcgactac

SEQ ID NO: 33781 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtacccttcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33782 - DNA, 295 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33783 - DNA, 287 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacacagcccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33784 - DNA, 350 bp, Artificial
  Mutation in BnaC.FAD2.a introduced by TALE nuclease pair BnFAD2_T03
caggatccatgggtgcaggtggaataatgcaagtgtctcctccctccaagaagtctgaaaccgacaccatcaagcgcgtaccctgcgagacaccgcccttcactgtagaactcaagaaagcaatcccaccgcactgtttcaaactctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33785 - DNA, 280 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtcgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 33786 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccatggctgcgtcctaaccggcgtctgggtcatagcccacgagtgcggccaccacgccttcagcgactac

SEQ ID NO: 33787 - DNA, 370 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcaatggcaagcaggcgctggagacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33788 - DNA, 336 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccaccgcactgtttcaaacgctcgatccctcgctctttctcctacctcatctgggacatcatcatagcctcctgcttctactacgtcgccaccacttacttccctctcatccctcaccctctctcctacttcgcctggcctctctactgggcctgccaagggtgcgtcctaaccggcgtctgggtcatagcccacgagtgcggccaccacgccttcagcgactac

SEQ ID NO: 33789 - DNA, 277 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgggacatcatcatagcctcctgcttctactacgtcgccaccacttacttccctctcctccctcaccctctctcctacctcgcctggcccctctactgggcctgccaaggctgcgtcctaacgggcctctgggtcatagcccacgagtgcggccaccacgccttcagcgactac

SEQ ID NO: 33790 - DNA, 344 bp, Artificial
  Mutation in BnaC.FAD2.a introduced by TALE nuclease pair BnFAD2_T03
caggatccatgggtgcagctggaagaatgcaagtgtctcctccatccaaaaagtctgaaaccgacaccatcaagcgcgtaccctgcgagacaccgcccttcactgtcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttctgcgactac

SEQ ID NO: 33791 - DNA, 349 bp, Artificial
  Mutation in BnaC.FAD2.a introduced by TALE nuclease pair BnFAD2_T03
caggatccatgggtgcaggcggaagaatgcaagtctctactcccacaagctcccccgaaaccaaaaccatcaaacgagtcccctgcgagacaccacccttcactcagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcccggcctctctactgggcctgccaagggtgcgtcctaaccggcgtctggggcatagcccacgagtgcgtccaccacgcctgcagcgactac

SEQ ID NO: 33792 - DNA, 416 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgcccacggcttgaccccggagcaggtggtggccatcgccagccacgatggcggcaagcaggcgctggaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33793 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctctctctttctcctacctcatctgggacatcatcatagcctcctgcttctactacgtcgccaccccttacttccctctcctccctcaccctctctcctacttcgcctggcctctctacggggcctgccaagggtgcgtcctaacgggcctctgggtcatcgcccacgaatgcgtccaccacgccttcagcgactac

SEQ ID NO: 33794 - DNA, 333 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 33795 - DNA, 348 bp, Artificial
  Mutation in BnaC.FAD2.a introduced by TALE nuclease pair BnFAD2_T03
caggatccatgggtgcaggtggaagaatgcaagtgtctactccctccaaaaagtctgaaaccgacaccatcaagcgcgtaccctgcgagacaccgcccttcactggaactcaagaaagcaatcccaccgcactgtttcaaacgctcgatccctcgctctttctcctacctcatctgggacatcagcatagcctcctgcttctactacgtcgccacctcttacttccctctcctccctcaccctctctcctacttcgcctggcctctctactgggcctgccaagggtgcggcctaaccggcgtctgggtcatcgcccacgaatgcggccaccacgccttcagcgactac

SEQ ID NO: 33796 - DNA, 338 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33797 - DNA, 338 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcaagatagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33798 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccacactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33799 - DNA, 351 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33800 - DNA, 346 bp, Artificial
  Mutation in BnaC.FAD2.a introduced by TALE nuclease pair BnFAD2_T03
caggatccatgggtgcaggtggcagaatgcaagtctctcctccctcccgctcccccgaaaccaaaaccctcaaacgcgtcccctgcgagacaccacccttcactacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33801 - DNA, 431 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggctgttgccggtgctgtgccaggcccacggcttgaccccggagcaggtggtggccatcgccagccacgatggcggcaagagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33802 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcctctgggtcatagcccacgagtgcggccaccacgccttcagcgactac

SEQ ID NO: 33803 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33804 - DNA, 347 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacggcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33805 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33806 - DNA, 344 bp, Artificial
  Mutation in BnaC.FAD2.a introduced by TALE nuclease pair BnFAD2_T03
caggatccatgggtgcaggtggaagaatgcaagtgtctcctccatccaagaagtctgaaccctacaccatcaagcgcctaccctgcgagacaccgccctacacactcaagaaaccaatcccaccgcactgtttcaaacgctcgatccctctcgctttctcctacctcagctgggacatcatcatagcctcctgcttctactacgtcgccaccacttacttccctctcctccctcaccctctctcctacttcgcctggcccctctgctgcgcctgccaagggtgcgtcctaaccggcgtctgggtcatagcccacgagtgcggccaccacgccttcagcgactac

SEQ ID NO: 33807 - DNA, 344 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactctcaagaaagcaatcccaccgcactgtttcaaacgctcgatccctcgctctttctcctacctcatctggcacatcagcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 33808 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcggggtcatagcccacgagtgcggccaccacgccttcagcgactac

SEQ ID NO: 33809 - DNA, 347 bp, Artificial
  Mutation in BnaC.FAD2.a introduced by TALE nuclease pair BnFAD2_T03
caggatccatgggtgcaggtggaagaatgcaagtgtctactcccaccaaaaagtctgaaaccgacaccatcaagcgcgtaccctgcgagacaccgcccttcactgtactcaagaaagcaatcccaccgcactgtttcaaacgctcgaaccctcgctctttctcctacctcacctgggacatcatcatagcctcctgcttctactacgtcgccacctctcacttccctctcctccctcaccctctctcctacctcgcctggcctctctactgggcctgccaagggtgcgtcctaaccggcgtctgggtcatagcccacgagtgcggccaccacgccttcagcgactac

SEQ ID NO: 33810 - DNA, 349 bp, Artificial
  Mutation in BnaC.FAD2.a introduced by TALE nuclease pair BnFAD2_T03
caggatccatgggtgcaggtggaagaatgctagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33811 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcagactcaagaaagcaatcccaccgcactgtttcaaacgctcgatccctagctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgtggccaccacgccttcagcgactac

SEQ ID NO: 33812 - DNA, 348 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33813 - DNA, 412 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgactgggcctttcgttttatctgttgtttgtcggtgaacgctctcctgagtaggacaaatccggagaactcaagaaagcaaccccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33814 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcataggccacgagtgcggccaccacgccttcagcgactac

SEQ ID NO: 33815 - DNA, 345 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 33816 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactctagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33817 - DNA, 351 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33818 - DNA, 402 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtccagcgcctgcttgccgccatcgtggctggcgatggccaccacctgctccggagaactcaagaaagcaatcccaccgcactgtttcaaacgctcgatccctcgctctttctcctacctcatctgggacatcatcatagcctcctgcttctactacgtcgccaccccttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33819 - DNA, 342 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctctccctctctcctacttcgcctggcctctctactgggcctgccaagggtgcgtcctaaccggcgtctgggtcatagcccacgagtgcggccaccacgccttcagcgactac

SEQ ID NO: 33820 - DNA, 350 bp, Artificial
  Mutation in BnaC.FAD2.a introduced by TALE nuclease pair BnFAD2_T03
caggatccatgggtgcaggtgggagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctaccgggcctgccaagggtgcgtcctaaccggcgtctgggtcatagcccacgagtgcggccaccacgccgtcagcgactac

SEQ ID NO: 33821 - DNA, 343 bp, Artificial
  Mutation in BnaC.FAD2.a introduced by TALE nuclease pair BnFAD2_T03
caggatccatgggtgcaggtggaagaatgcaagtgtctcctccttccaagaagtcttaaaccgacaccatcaagcgcgtaccctgcgagacaccgcccttcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33822 - DNA, 409 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggccagttaccttcggaaaaagagttggtagctcttgatccggcaaacaaaccaccggagaactcaagaaagcaatcccactgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33823 - DNA, 348 bp, Artificial
  Mutation in BnaC.FAD2.a introduced by TALE nuclease pair BnFAD2_T03
caggatccatgggtgcaggtggcagaatgcaagtgtctcctcaatccaaaaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgcctggcctctctactgggcctgccaagggtgcgtcctaaccggcgtctgggtcatagcccacgagtgcggccaccacgccttcagcgactac

SEQ ID NO: 33824 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 33825 - DNA, 349 bp, Artificial
  Mutation in BnaC.FAD2.a introduced by TALE nuclease pair BnFAD2_T03
caggatccatgggtgcaggtggaagaatgcaagtctttcctccctcccgctcccccgaaaccaaaaccctcaaacgcgtcccctgcgagacaccacccttcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgcctggcctctctactgggcctgccaagggtgcgtcctaaccggcgtctggggcatagcccacgaggtcggccaccacgccttcagcgactac

SEQ ID NO: 33826 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 33827 - DNA, 400 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcggcctttttacggttcctggccttttgctggccttttgctcacatgttctttcctgcgttatcccccgggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33828 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 33829 - DNA, 277 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgatcgagcgtttgaaacagtgcggtgggattgctttcttgagttctccctctcctccctcaccctctctcctacttcgcctggcctctctactgggcctgccaaggctgcgtcctaacgggcctctgggtcatagcccacgagtgcggccaccacgccttcagcgactac

SEQ ID NO: 33830 - DNA, 393 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggtggtggccatcgccagcaatattggtggcaagcaggcgctgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 33831 - DNA, 300 bp, Artificial
  Mutation in BnaC.FAD2.a introduced by TALE nuclease pair BnFAD2_T03
caggatccatgggtgcaggtggaagaatgcaagtgtctcctccctccagctcccccgaaaccaaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcggctgggtcatagcccacgagtgcggccaccacgccttcagcgactac

SEQ ID NO: 33832 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 33833 - DNA, 357 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggtccagcggctgttgccggagaactcaagaaagcaatcccaccgcactgtttcaaacgctcgatccctcgctctttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 33834 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgacggagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 33835 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctccctcatctgggacatcatcatagcctcctgcttctactacgtcgccaccacttacttccctctcctccctcaccctctctcctccttcgcctggcctctctactgggcctgccaagggtgcgtcctaaccggcgtctgggtcatagcccacgagtgcggccaccacgccttcagcgactac

SEQ ID NO: 33836 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactctcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33837 - DNA, 385 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggtcagggtgccggccttgatcatctcgccgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgcctgcagcgactac

SEQ ID NO: 33838 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacacgtcccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33839 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgattgcggccaccacgccttcagcgactac

SEQ ID NO: 33840 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 33841 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcccgcagcgactac

SEQ ID NO: 33842 - DNA, 349 bp, Artificial
  Mutation in BnaC.FAD2.a introduced by TALE nuclease pair BnFAD2_T03
caggatccatgggtgcaggtgcaagaatgcaagtctctcctccatccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgccgggcctctctactgggcctgccaagggtgcgtcctaacgggcctctgggtcatagcccacgagtgcggccaccacgcctgtagcgactac

SEQ ID NO: 33843 - DNA, 357 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtttttgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33844 - DNA, 349 bp, Artificial
  Mutation in BnaC.FAD2.a introduced by TALE nuclease pair BnFAD2_T03
caggatccatgggtgcaggtggaagaatgcaagtgtctcctccctccaataagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33845 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccatcaccctctctcctacttcgcctggcctctctactgggcctgccaagggtgcgtcctaaccggcgtctgggtcatagcccacgagtgcggccaccacgcctgcagcgactac

SEQ ID NO: 33846 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatcgcccacgaatgcggccaccacgccttcagcgactac

SEQ ID NO: 33847 - DNA, 319 bp, Artificial
  Mutation in BnaC.FAD2.a introduced by TALE nuclease pair BnFAD2_T03
caggatccatgggtgcaggtggaagaatgcaagtttctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggtctgccaagggtgcgtcctaaccggcgtctgggtcatagcccacgagtgcggccaccacgccttcagcgactac

SEQ ID NO: 33848 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagtgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33849 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33850 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 33851 - DNA, 287 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacacagcccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33852 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactaaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggagtctgcgtcatagcccacgagtgcggccaccacgccttcagcgactac

SEQ ID NO: 33853 - DNA, 316 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagaactcaagaaagcaatcccaccgcactgtttcaaacgctcgatccctcgctctttctcctacctcatctgggacatcatcatagcctcctgcttctactacgtcaccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33854 - DNA, 402 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgcccacggcttgaccccggagcaggtggtggccatcgccagccacgatggcggcaagcaggcgctggaagaactcaagaaagcaatcccaccgcactgtttcaaacgctcgatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 33855 - DNA, 398 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcaacagccgctggaccgtctccagcgcctgcttgccaccattattgctggcgagaactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 33856 - DNA, 372 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcttgacaccattattgccggcgatggccaccacctgccatcccacgatccagacctcaagacagcaatcccacctcactgcttcaaacgctccatcccacgctccttctcctcttcgacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33857 - DNA, 447 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccccagcaggtggtggccatcgccagcaataatggtggcaagcaggcgctggagacggtgctgtgccaggcccacggcttgaccccccagcaggtggtggccatcgccagcaaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33858 - DNA, 351 bp, Artificial
  Mutation in BnaC.FAD2.a introduced by TALE nuclease pair BnFAD2_T03
caggatccatgggtgcaggtggaagaatgcaagtgtcacctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33859 - DNA, 332 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33860 - DNA, 350 bp, Artificial
  Mutation in BnaC.FAD2.a introduced by TALE nuclease pair BnFAD2_T03
caggatccatgggtgcaggtggaagaatgcaagtgtctactccctacaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33861 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactgtagaactcaagaaagcaatcccaccgcactgtttcaaacgctcgatccctcgctctttctcctacctcatccgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagggcggccaccacgccttcagcgactac

SEQ ID NO: 33862 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcacctcaagaaagcaatcccacctcactgcttcaaacgctcgattcctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33863 - DNA, 341 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33864 - DNA, 351 bp, Artificial
  Mutation in BnaC.FAD2.a introduced by TALE nuclease pair BnFAD2_T03
caggatccatgggtgcaggtggaagaatgcaagtgtctcctccatccaagaagtctgaaaccgacaccatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33865 - DNA, 347 bp, Artificial
  Mutation in BnaC.FAD2.a introduced by TALE nuclease pair BnFAD2_T03
caggatccatgggtgcaggtggcagaatgcaagtctctcctccctccagctcccccggaaccaacaccctcaaacgcgtcccctgcgagacaccgcccttcactgttaccgcgaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacttggcctgccaagggtgcgtcctaaccggcgtctgggtcatagcccacgagtgcggccaccacgccttcagcgactac

SEQ ID NO: 33866 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaagaactcaagaaagcaaccccaccgcactgttccaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccatcagcgactac

SEQ ID NO: 33867 - DNA, 359 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacgtctccagcgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccactagtgcggccaccacgccttcagcgactac

SEQ ID NO: 33868 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctccatccctcgctccttctcctacctcctcttcgacatcctcgtctcctcctccctctaccacctctccacagcctacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 33869 - DNA, 342 bp, Artificial
  Mutation in BnaC.FAD2.a introduced by TALE nuclease pair BnFAD2_T03
cagtatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgtggccaccacgccttcagcgaatac

SEQ ID NO: 33870 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33871 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagctcaagaaagcaatcccaccgcactgtttcaaacgctcgatccctcgctctttctcctacctcatctgggacatcatcatagcctcctgcttctactacgtccccaccacttacttccctctcctccctcaccctctctcctacttcgcctggcctctctacggggcctgccaagggtgcgtcccaacgggcctctgggtcatagcccacgagtgcggccaccacgcctgcagcgacta

SEQ ID NO: 33872 - DNA, 370 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggtgaacgctctcctgagtagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgtggccaccacgccttcagcgactac

SEQ ID NO: 33873 - DNA, 280 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33874 - DNA, 277 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcggcgactac

SEQ ID NO: 33875 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 33876 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgctcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 33877 - DNA, 423 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgactacggcgtgatcgtggacaccacgagcatcacaaaaatcgacgctcaagtcagaggtggcgaaacccggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33878 - DNA, 319 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 33879 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 33880 - DNA, 342 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33881 - DNA, 408 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggacttcgctgctacccaaggttgccgcgtgacgcacaccgtggaaacggatgaaggagcactcaagaaagcaatcccaccgcactgtttcaaacgctcgatccctcgctccttctcctacctcctcttcgacatcctcgtctcctcccccctctaccacccctccaccgcctacttccctcccccccccccccctctcccttacctcgcctggcccctctactgggcctgccaaggctgcgtcctaacgggcgtctgggtcatagcccacgagtgcggccaccacgccttcagcgactac

SEQ ID NO: 33882 - DNA, 338 bp, Artificial
  Mutation in BnaC.FAD2.a introduced by TALE nuclease pair BnFAD2_T03
caggatccttgggtgcaggtggaagaatgcaagtgtctcctccctccaagaagtctgaaaccgacaccatcaagcgcgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33883 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccatcaagcgcgtcccatgcgagacaccacccttcactaagacctcaagaaagcaatcccacctcactgcttcaaacgctcgatccctcgctctttctcctacctcatctgggacatcatcatagcctcctgcttctactacgtcgccaccacttacttccctctcctccctcaccctctctcatacttcgcctggcctctctactgggcctgccaagggtgcgtcctaaccggcgtctgggtcatagcccacgagtgcggccaccacgccttcagcgactac

SEQ ID NO: 33884 - DNA, 356 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 33885 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccatcccaccgcactgtttcaaacgctccatcccacgctccttctcctcttcgacatcatcatctcctcctccctctaccacctctccacagcctacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 33886 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaactctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 33887 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33888 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 33889 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 33890 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatagcccacgagtgcggccaccacgccttcagcgactac

SEQ ID NO: 33891 - DNA, 414 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggagacggtccagcggctgttgccggtgctgtgccaggcccacggtccagcggctgttgccggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagggcggccaccacgccttcagcgactac

SEQ ID NO: 33892 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 33893 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgaactcaagaaggcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33894 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcaggactac

SEQ ID NO: 33895 - DNA, 334 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33896 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctcaactgggcctgccaagggtgcgtcctaaccggcgtctgggtcatagcccacgagtgcggccaccacgccttcagcgactac

SEQ ID NO: 33897 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttactcccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33898 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccataaagcgcgtaccctgcgagacaccgcccttcactgtagaactcaagaaagcaatcccaccacactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 33899 - DNA, 348 bp, Artificial
  Mutation in BnaC.FAD2.a introduced by TALE nuclease pair BnFAD2_T03
caggatccatgggtgcaggtggaagaatgcaagtctctcctcaatacagctcccccggaaccaacaccctcaaacgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcgtccaccacgccatcagcgactac

SEQ ID NO: 33900 - DNA, 312 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactgtttcaaacgctcgatccctcgctctttcttctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 33901 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccaggcctctctactgggcctgccaagggtgcgtcctaaccggcgtctgggtcatagcccacgagtgcggccaccacgccttcagcgactac

SEQ ID NO: 33902 - DNA, 356 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcggagaactcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33903 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 33904 - DNA, 345 bp, Artificial
  Mutation in BnaC.FAD2.a introduced by TALE nuclease pair BnFAD2_T03
catgatccatgggtgcaggtggaagaatgcaagtgtctcctccctccaagaagtctgaaaccgacaccatcaagcgcgtaccctgcgagacaccgcccttcacaactcaagaaagcaatcccaccgcactgtttcaaacgctcgatccctcgctctttctcctacctcatctgggacatcatcatagcctccttcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33905 - DNA, 350 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33906 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33907 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgtgtcatagcccacgagtgcggccaccacgccttcagcgactac

SEQ ID NO: 33908 - DNA, 342 bp, Artificial
  Mutation in BnaC.FAD2.a introduced by TALE nuclease pair BnFAD2_T03
caggatccatgggtgcaggtgaaagaatgcaagtgtctcctccctccaagaagtctgaaaccgacaccatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagggcggccaccacgccctcagcgactac

SEQ ID NO: 33909 - DNA, 290 bp, Artificial
  Mutation in BnaC.FAD2.a introduced by TALE nuclease pair BnFAD2_T03
caggatccatgggtgcaggtggaagaatgcaagtctctcctctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33910 - DNA, 349 bp, Artificial
  Mutation in BnaC.FAD2.a introduced by TALE nuclease pair BnFAD2_T03
caggatccatgggtgcaggcggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33911 - DNA, 352 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 33912 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcgaacgctcgatccctcgctctttctcctacctcatcttggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33913 - DNA, 336 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33914 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 33915 - DNA, 413 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggatgggatccgatccaatgaagacaatcgacatagtgactggatatgttgtgttttacagagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 33916 - DNA, 308 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccatcagcgactac

SEQ ID NO: 33917 - DNA, 352 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgaatac

SEQ ID NO: 33918 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgtcaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33919 - DNA, 351 bp, Artificial
  Mutation in BnaC.FAD2.a introduced by TALE nuclease pair BnFAD2_T03
gcaggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33920 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 33921 - DNA, 277 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactctcgatcgagcgtttcaaacagtcccgtgggattgctttcttgagttccccctctcctccctctccctctctcctacttcgcctggcctctctactgggcctgccaagggtgcgtcctaaccggcgtctgggtcatagcccacgagtgcggccaccacgccttcagcgactac

SEQ ID NO: 33922 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagccttctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33923 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccatgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33924 - DNA, 338 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaaaacaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcgaccaccacgccttcagcgactac

SEQ ID NO: 33925 - DNA, 352 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtggagaacccaagaaagcaatcccaccgcactgtttcaaacgctcgatcccccgctctttctcctacctcatctgggacatcatcatagcctcctgcttctactacgccgccaccacttacttccctctcctccctcaccctctctcctacttcgcctggcctctctactgggcctgccaagggtgcgtcctaaccggcgtctgggtcatagcccactaatgcggccaccacgccttcagcgactac

SEQ ID NO: 33926 - DNA, 280 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaccgtcgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33927 - DNA, 395 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggcggccatctccagcaatcgctgtcgccaccctgctctggagactgagaactcaagaaatcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 33928 - DNA, 437 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtctccagcgcctgcttgccaccattattgctggcgatggccaccacctgctggggggtcaagttgagcggggcacccgtcagtgcatgagaactcaagaaagcaatcccaccgcactgtttcaaacgctcgatccctcgctctttctcctacctcatctgggacatcatcatagcctcctgcttctactacgtcgccaccacttacttcccgctcctccctcaccctctctcctacttcgcctggcctctctactgggcctgccaagggtgcgtcctaaccggcgtctgggtcatagcccacgagtgcggccaccacgccttcagcgactac

SEQ ID NO: 33929 - DNA, 386 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcgccagccacgatggcggcaacagccgctggaccggagaactcaagaaagcaatcccaccgcactgtttcaaacgctcgatccctcgctctttctcctacctcatctgggacatcatcatagcctactgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33930 - DNA, 403 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtaccctgcgagacaccgcccttcactgttaggtacctcgcgaatgcatctagatccaatgatcatgagcggagaattaaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccactccttcagcgactac

SEQ ID NO: 33931 - DNA, 348 bp, Artificial
  Mutation in BnaC.FAD2.a introduced by TALE nuclease pair BnFAD2_T03
caggatccatgggtgcggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33932 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33933 - DNA, 377 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcgctcggtcgttcggctgcggcgagcggtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33934 - DNA, 400 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcaccggcaacagccgctggaccgtctccagcgcctgcttgccaccagagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 33935 - DNA, 277 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgatcgagcgtttgaaacagtgcggtgggattgctttcttgagttctccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 33936 - DNA, 349 bp, Artificial
  Mutation in BnaC.FAD2.a introduced by TALE nuclease pair BnFAD2_T03
caggatccatgggtgcaggtgaaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33937 - DNA, 354 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33938 - DNA, 352 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 33939 - DNA, 452 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcggtggccatcgccagcaataatggtggcaggtggtggccatcgccagcaatggcggtggcaagcaggcgctggagacggtccagcggctgttgccggtgcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33940 - DNA, 436 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgggcttgaccccccagcagggggtggccatcgccagcaataatggtggcaagcaggcgctggagacggtccagcggctgttgccggagacctcaagaaagcaatcccaccgcactgtttcaaacgctcgatccctcgctctttccccatcctcagcagggacatcatcatagcctcctgcttctactacgtcgccaccacgtacttccctctccgccctcaccctctctcctacttcgcctggcctctctacggggcctgccaagggtgcggcctaaccggcgtctgggtcatagcccacgagtgcggccaccacgccttcagcgactac

SEQ ID NO: 33941 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgcctggcctctctactgggcctgccaagggtgcgtcctaaccggcgtctgggtcatagcccacgagtgcggccaccacgccttcagcgactac

SEQ ID NO: 33942 - DNA, 350 bp, Artificial
  Mutation in BnaC.FAD2.a introduced by TALE nuclease pair BnFAD2_T03
caggatccatgggtgcaggtggaagaatgcaagtgtcaactccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33943 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacaagtgcggcctccacgccatcagcgactac

SEQ ID NO: 33944 - DNA, 344 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccatagcctttctagaaagcaatcccaccgcactgtttcaaacgctcgatccctcgctctttctcctacctcatctgggccatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33945 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtacccttcgagacaccgcccttcactgtgaactcaagaaagcaatcccaccgcactgtttcaaacgctcgctccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33946 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatcccccgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33947 - DNA, 379 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggtcatagcattggatcggatcccgggcccgagaactcaagaaatcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33948 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 33949 - DNA, 349 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatatgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33950 - DNA, 354 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33951 - DNA, 347 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 33952 - DNA, 343 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccagcagcgactac

SEQ ID NO: 33953 - DNA, 319 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33954 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcataaccggcgtctgggtcatagcccacgagtgcggccaccacgccttcagcgactac

SEQ ID NO: 33955 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacgtacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33956 - DNA, 349 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccaagggtgcgtcctaaccggcgtctgggtcatagcccacgagtgcggccaccacgccttcagcgactac

SEQ ID NO: 33957 - DNA, 334 bp, Artificial
  Mutation in BnaC.FAD2.a introduced by TALE nuclease pair BnFAD2_T03
caggatccatgggtgcaggtggaagaatgcaagtgtctcctccttccaagaagtctgaaaccgacaccatcaagcgcgtaccctgcgagacaccgcccttcactggaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 33958 - DNA, 347 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaacatcaagcgcgtaccctgcgagacaccgcccttcacagaactcaagaaagcaatcccaccgcactgtttcaaacgctcgatccctcgctctttctcctacctcatctgggacatcatcatagcctcctgcttctactacgtcgccgccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33959 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccgcttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33960 - DNA, 295 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagggcggccaccacgccttcagcgactac

SEQ ID NO: 33961 - DNA, 409 bp, Artificial
  Mutation in BnaC.FAD2.a introduced by TALE nuclease pair BnFAD2_T03
caggatccatgggtgcaggtggcagaatgcaagtgtcttctctctccaagaagtctgaaaccgacaccatcaagcgcgtaccctgcgagacaccgcccttcactgtcaggcccacggcttgaccccggagcaggtggtggccatcgccagcaatattggtggcggagaactcaagaaagcaatcccaccgcactgtttcaaacgctcgatccctcgctctttctcctacctcatctgggacatcatcatagcctcctgcttctactacgtcgccaccacttccttccctctcctccctcaccctctctcctacttcgcctggcctctctactgggcctgccaagggtgcgtcctaaccggcgtctgggtcatagcccacgagtgcggccaccgcgccttcagcgactac

SEQ ID NO: 33962 - DNA, 357 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttttgttagaactcaagaaagcaatcccaccgcactgtttcaaacgctcgatccctcgctctttctcctacctcctctgggacatcatcatagcctcctgcctctactacgtcgccaccacttacttccctctcctccctcaccctctcccctacttcgcctggcctctctactgggcctgccaagggtgcgtcctaaccggcgtctgggtcatagcccacgagtgcggccaccacgccttcagcgactac

SEQ ID NO: 33963 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccctccactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 33964 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33965 - DNA, 308 bp, Artificial
  Mutation in BnaC.FAD2.a introduced by TALE nuclease pair BnFAD2_T03
caggatccatgggtgcaggtggaagaattcaagtgtcaactccctacaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccatgagtgcggccaccacgccttcagcgactac

SEQ ID NO: 33966 - DNA, 386 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcgccagccacgatggcggcaacagccgctggaccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgacaagggtgcgtcctaaccggcgtctgggtcatagcccacgagtgcggccaccacgccttcagcgactac

SEQ ID NO: 33967 - DNA, 328 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccaccgcactgtttcaaacgctcgatccctcgctctttctcctacctcatctgggacatcatcatagcctcctgcttctactacgtcgccaccacttacttccctctccctcaccctctctcctacttcgcctggcctctctactgggcctgccaagggtgcgtcctaaccggcgtctgggtcatagcccacgagtgcggccaccacgccttcagcgactac

SEQ ID NO: 33968 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaaacgcgtaccctgcgagacaccgcccttcactgtagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 33969 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctcaccggcgtctgggtcatagcccacgagtgcggccaccacgccttcagcgactac

SEQ ID NO: 33970 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgctcacgaatgcggccaccacgccttcagcgactac

SEQ ID NO: 33971 - DNA, 452 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggtggccatcgccagcaataatggtggcaggtggtggccatcgccagcaatggcggtggcaagcaggcgctggagacggtccagcggctgttgccggtgcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33972 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctggaaccgacaccatcaagcgcgtaccctgcgagacaccgcccttcactgaactcaagaaagcaatcccaccgcactgtttcaaacgctcgatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33973 - DNA, 349 bp, Artificial
  Mutation in BnaC.FAD2.a introduced by TALE nuclease pair BnFAD2_T03
caggatccatgggtgcaggtggaagaatgcaagtctctcctccctccaactcgtctgaaaccgacaccctcaagcgcgtaccctgcgagacaccgcccttcactgtgaactcaagaaagcaatcccaccgcactgtttcaaacgctcgatccctcgctctttctcctacctcatctccgacatcctcatagcctcctgcctctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33974 - DNA, 349 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgttaactcaagaaagcaatcccaccgcactgtttcaaccgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33975 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 33976 - DNA, 447 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctaggcgccttatccggtaactatcgtcttgagtccaacccggtaagacacgacttatcgccactggcagcagccactggtaacaggattagcagagcgaggtatgtagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33977 - DNA, 352 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccaggagtgcggccaccacgccttcagcgactac

SEQ ID NO: 33978 - DNA, 277 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgggacatcatcatagcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 33979 - DNA, 343 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33980 - DNA, 338 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 33981 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaactcaagaaaccaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33982 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctcttcgacatcatcatctcctcctcggctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 33983 - DNA, 342 bp, Artificial
  Mutation in BnaC.FAD2.a introduced by TALE nuclease pair BnFAD2_T03
caggatccatgggtgcaggtggaagaatgcaagtctctcctccctccagctcccccggaaccgacaccatcaagcgcgtaccctgcgagacaccgcccttccctcaagaaagcaatcccaccgcactgtttcaaacgctcgatccctcgctctttctcctacctcatctgggacatcatcatagcctccttcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33984 - DNA, 410 bp, Artificial
  Mutation in BnaC.FAD2.a introduced by TALE nuclease pair BnFAD2_T03
caggatccatgggtgcaggtggaagaatgcaagtgtctcctcactccaagaagtctgaaaccgacaccatcaagcgcgtaccctgcgagacaccgcccttcactgtcggttcagcctggtcagctgggccttgtagttgcccttgaagtggccggacacgaacaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 33985 - DNA, 280 bp, Artificial
  Mutation in BnaC.FAD2.a introduced by TALE nuclease pair BnFAD2_T03
caggatccatgggtgcaggtggaagaatgcaagtgtctaccccctccaagaagtctgaaaccgacaccatcaagcgcgtaccctgcgagacaccgcccttcactgtcgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33986 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaaactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 33987 - DNA, 356 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactttgctccaagaactcaagaaagcaatcccaccgcactgtttcaaacgctcgatccatcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33988 - DNA, 351 bp, Artificial
  Mutation in BnaC.FAD2.a introduced by TALE nuclease pair BnFAD2_T03
caggatccatgggtgcaggtggcagaatgcaagtgtctcctccctccaaaaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33989 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33990 - DNA, 422 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcaagcaggcgctggagacggtccagcggctgttgccggtgctgtgccaggcccacggcttgaccacggcagaactcaagaaagcaatcccaccgcactgtttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33991 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 33992 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgcccccacttacttccctctcctccctcaccctctctcctacttcgccaggcccctctactgggcctgccaaggctgcgtcctaacgggcctctgggtcatcgcccacgaatgcggccaccacgccttcagcgactac

SEQ ID NO: 33993 - DNA, 343 bp, Artificial
  Mutation in BnaC.FAD2.a introduced by TALE nuclease pair BnFAD2_T03
catgatccatgggtgcaggtggaagaatgcaagtgtctcctccctccaagaagtctgaaaccgacaccatcaagcgcgtaccctgcgagacaccgcccttcactgtaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 33994 - DNA, 388 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcacccgtcagtgcattgcgccatgcatgcactgcctccagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33995 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaacctacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 33996 - DNA, 368 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagcaatggcggtggccggagaactcaagaaagcaatcccaccgcactgtttcaaacgctcgatccctcgctctttctcctacctcatctgggacatcatcatagcctcctgcttctactacgtcgccaccacttacttccctctcctccctcacccactctcctacttcgcctggcctctctactgggcctgccaagggtgcgtcctaaccggcgtctgggtcatagcccacgagtgcggccaccacgccttcagcgactac

SEQ ID NO: 33997 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaatcgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcctggcctctctactgggcctgccaaggctgcgtcctaacgggcctctgggtcatagcccacgagtgcggccaccacgccttcagcgactac

SEQ ID NO: 33998 - DNA, 350 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtaaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 33999 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacggggcctgccaagggtgcgtcctaaccggcgtctgggtcatagcccacgagtgcggccaccacgccttcagcgactac

SEQ ID NO: 34000 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 34001 - DNA, 351 bp, Artificial
  Mutation in BnaC.FAD2.a introduced by TALE nuclease pair BnFAD2_T03
caggatccatgggtgcaggtgggagaatgcaagtgtctcctccctcaaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcccggcctctctactgggcctgccaagggtgcgtcctaaccggcgtctgggtcatagcccacgagggcggccaccacgccttcagcgactac

SEQ ID NO: 34002 - DNA, 432 bp, Artificial
  Mutation in BnaC.FAD2.a introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactctcggagcaggtggtggccatcgccagcaatattggtggcaagcaggcgctggagacggtgcaggtggtggggtcaagccgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34003 - DNA, 326 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaaagcaatcccaccgcactgtttcaaacgctccatcccacgctccttctcctacctcctcttcgacatcctcgtctcctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 34004 - DNA, 345 bp, Artificial
  Mutation in BnaC.FAD2.a introduced by TALE nuclease pair BnFAD2_T03
caggatccatgggtgcaggtggaagaatccaagtgtccactccctccaagaagtctgaaaccgacaccatcaagcgcgtaccctgcgagacaccgcccttcacaactcaagaaagcaatcccaccgcactgtttcaaacgctcgatccctcgctctttctcctacctcatctgcgacatcatcatagcctcctgcttctactacgtcgccaccacttacttccctctcctccctcaccctctctcctacttcgcctggcctctctactgggcctgccaagggtgcgtcctaaccggcgtctgggtcatagcccacgtgtgcggccaccacgcctacagcgactac

SEQ ID NO: 34005 - DNA, 277 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtcgatcgagcgtttgaaacagtgcggtgggattgctttcttgagttctccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34006 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34007 - DNA, 412 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccctttacgtgaaccatcgccctgatagacggtttttcgccctttgacgttggagtccacgttctttaatagtggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34008 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 34009 - DNA, 331 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctaactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctaggtcatagcccacgagtgcggccaccacgccttcagcgactac

SEQ ID NO: 34010 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctcgatccctcgctctgtctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34011 - DNA, 455 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggggtcaagccgtgggcctggcacagcaccggcaacagccgctggaccgtctccagcgcctgcttgccaccatcgtggctggcgatggccaccacctcctccggagaactcaagaaagcaatcccaccgcactgtttcaaacgctcgatccctcgctctttctcctacctcatctgggacatcatcatagcctcctgcttctactacgtcgcccccgcttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 34012 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 34013 - DNA, 310 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaactcaagaaagcaatccccccgcactgtttcaaacgcaccatcccacgctccttctcctcttcgacatcatcatctcctcctcggctcctccctcaccctctctcctacttcgcctggcctctctactgggcctgccaaggctgcgtcctaacgggcctctgggtcatagcccacgagtgcggccaccacgccttcagcgactac

SEQ ID NO: 34014 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccaccgcactgtttcaaacgctcgatccctcgctctttctcctacctcatctgggacatcatcatagcctcctgcttctactacgtcgccaccacttacttccctctcctacctcaccctctctcctacttcgcctggcctctctactgggcctgccaagggtgcgtcctaaccggcgtctgggtcatagcccacgagtgcggccaccacgccttcagcgactac

SEQ ID NO: 34015 - DNA, 371 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttttgacggggtcagtgccttaagtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccatgggtgcgtcctaaccggcgtctgggtcatagcccacgagtgcggccaccacgccttcagcgactac

SEQ ID NO: 34016 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 34017 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcggcctaaccggcgtctgggtcatagcccacgagtgcggccaccacgccttcagcgactac

SEQ ID NO: 34018 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34019 - DNA, 436 bp, Artificial
  Mutation in BnaC.FAD2.a introduced by TALE nuclease pair BnFAD2_T03
caggatccatgggtgcaggtggaagaatgcaagtgtatactccctccaagaagtctgaaaccgacaccatcaagcgcgtaccctgcgagacaccgcccttcactgtagacatttcacgtagtggacaaattcttccaactgatctgcgcgcgaggccaagcgatcttcttcttgtccaagataagcctgtctagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagcgtgcgtcctaaccggcgtctgggtcatagcccacgtgtgcggccaccacgccttcagcgactac

SEQ ID NO: 34020 - DNA, 408 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggctgcggcgagcggtatcagctcactcaaaggcggtaatacggttatccacagaatcagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcgcgactac

SEQ ID NO: 34021 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaccgcgtcccctgcgagacaccaccattcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34022 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatagcccacgagtgcggccaccacgccttcagcgactac

SEQ ID NO: 34023 - DNA, 349 bp, Artificial
  Mutation in BnaC.FAD2.a introduced by TALE nuclease pair BnFAD2_T03
caggatccatgggtgcaggtggaacaatgcaagtgtctcctccctccaagaagtctgaaaccggcaccatcaagcgcgtaccctgcgagacaccgcccttcactgtatcatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccatggctgcgtcctaaccggcgtctgggtcatcgcccacgaatgcggccaccacgccttcagcgactac

SEQ ID NO: 34024 - DNA, 340 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtacggctgcggcgagcggagaactcaagaaagcaatccaaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34025 - DNA, 312 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactcgacctcaagaaagcaatcccacctcactgcttcaaacgctccatcccacgctccttctcctcttcgacatcatcatctcctcctcggctcctccctcaccctctctcctacttcgcctggcctctctactgggcctgccaagggtgcgtcctaaccggcgtctgggtcatagcccacgagtgcggccaccacgccttcagcgactac

SEQ ID NO: 34026 - DNA, 347 bp, Artificial
  Mutation in BnaC.FAD2.a introduced by TALE nuclease pair BnFAD2_T03
caggatccatgtgtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34027 - DNA, 412 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttcaggagagcgttcaccgacaaacaacagataaaacgaaaggcccagtcttccgactgagccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34028 - DNA, 416 bp, Artificial
  Mutation in BnaC.FAD2.a introduced by TALE nuclease pair BnFAD2_T03
caggatccatgggtgcaggtgggagaatgcaagtgtctcctccctccaaaaagtctgaaaccgacaccatcaagcgcgtaccctgcgagacaccgcccttcactgcccacggcttgaccccggagcaggtggtggccatcgccagccacgatggcggcaagcaggcgctggaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34029 - DNA, 348 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 34030 - DNA, 445 bp, Artificial
  Mutation in BnaC.FAD2.a introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactctcgggcaggtggtggccatcgccagcaatggcggtggcaagcaggcgctggagacggtccagcggctgttgccggtgctgtgccaggcccacggctagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34031 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccacactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34032 - DNA, 351 bp, Artificial
  Mutation in BnaC.FAD2.a introduced by TALE nuclease pair BnFAD2_T03
caggatccatgggtgcaggtggaagaatgcaagtgtctcctccctctaagaagtctgaaaccgacaccatcaagcgcgtaccctgcgagacaccgcccttcactgtcggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34033 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccagaactcaagaaagcaatcccaccgcactgtttcaaacgctcgatccctcgctctttctcctacctcatctgggacatcatcatagcctcctgcttctactacgtcgccaccacttacttgcctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34034 - DNA, 338 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctccaaaaacacacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 34035 - DNA, 397 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcggttcctggccttttgctggccttttgctcacatgttctttccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactacc

SEQ ID NO: 34036 - DNA, 347 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34037 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggatgcgtcctaaccggcgtctgggtcatagcccacgagtgcggccaccacgccttcagcgactac

SEQ ID NO: 34038 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 34039 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgaacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34040 - DNA, 335 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 34041 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 34042 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccttccaagggtgcgtcctaaccggcgtctgggtcatagcccacgagtgcggccaccacgccttcagcgactac

SEQ ID NO: 34043 - DNA, 391 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacggtccagcggcttttgccggtgctgtgccaggcccacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34044 - DNA, 326 bp, Artificial
  Mutation in BnaC.FAD2.a introduced by TALE nuclease pair BnFAD2_T03
caggatccatgggtgcaggtggaagaatgcaagtgtctcctccctccaagaagcctgaaaccgacaccctcaagcgcgtaccctgcgatacaccacccatcccaccgcactgtttcaaacgctcgatccctcgctctttctcctacctcatctgggacatcatcatctcctccttcttctactacgtcgccaccacttacttccctctcctcccccaccctctctcctacttcgcctggcctctctactgggcctgccaagggtgcgtcctaacgggcctctgggtcatcgcccacgaatgcggccaccacgccttcagcgactac

SEQ ID NO: 34045 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaaactcaagaaagcaatcccaccgcactgtttcaaacgctcgatccctcgctctttctcctacctcatctgggacatcatcatagcctcctgcttctaccacctctccacagcctacttccctctcctcccccaccctctcacttacctcgcctggcccctctactgggcctgccaaggctgcgtcctaacgggcctctgggtcatcgcccacgaatgcggccaccacgccttcagcgactac

SEQ ID NO: 34046 - DNA, 312 bp, Artificial
  Mutation in BnaC.FAD2.a introduced by TALE nuclease pair BnFAD2_T03
caggatccatgggtgcaggtggaagaatacaagtgtctcctccctccaagaagtctgaaaccgacaccatcaagcgcgtaccctgcgagacaccgcccttcactctccctcaagaaagcaatcccacctcactgcttcaaacgctccatccctcgctccttctcctcttcgacatcatcatctcctcctcggctcctccctcaccctctctcctacttcgcctggcctctctactgggcctgccaagggtgcgtcctaaccggcgtctgggtcatagcccacgagtgcggccaccacgccttcagcgactac

SEQ ID NO: 34047 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgtccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34048 - DNA, 359 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgtctccagcgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 34049 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggccctctactgggcctgccaagggtgcgtcctaaccggcgtctgggtcatagcccacgagtgcggccaccacgccttcagcgactac

SEQ ID NO: 34050 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagataccacccttcactagagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 34051 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcagactcaagaaagcaatcccaccgcactgtttcaaccgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34052 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcagactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 34053 - DNA, 307 bp, Artificial
  Mutation in BnaC.FAD2.a introduced by TALE nuclease pair BnFAD2_T03
caggatccatgggtgcaggtggaagaatgcaagtgtctcctcctctaagaaggccgaaaccgaacccaaccagacagcaatcccaccgcactctttcaaacgctcgatgcctcgatctttcaccaacctcatctctgccatcataatatcctcttgcacctactacgtcgccaccactaacttccctctcctccctcaccctctctcctacttcgcctggcctctctactgggcctgccaaggctgcggcctaacgggcctctggggcatagcccacgagtgcggccaccacgccttcagcgactac

SEQ ID NO: 34054 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagccaccacccttcactgagacctcaagaaagcaatcccacctcactgcttcaaacgctacatccctcgctccttctcctacctcatctgggacatcatcatagcctcctgcttctactacgtcgccaccacttacttccctctcctccctcaccctctctcctactacgcctggcctctctactgggcctgccaagggtgcgtcctagccggcgtctgggtcatagcccgcgagggcggccaccacgccgtcaggactac

SEQ ID NO: 34055 - DNA, 311 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcccaccgcactgtttcaaacgctcgatccctcgctctttctcctacctcatctgggacatcatcatagcctcctgcttctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 34056 - DNA, 347 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctatcctccctcaccctctctcctacttcgcctggcctctctactgggcctgccaagggtgcgtcctaaccggcgtctgggtcatagcccacgagtgcggccaccacgccttcagcgactac

SEQ ID NO: 34057 - DNA, 349 bp, Artificial
  Mutation in BnaC.FAD2.a introduced by TALE nuclease pair BnFAD2_T03
caggatccatgggtgcagtggaagaatgcaagtggctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34058 - DNA, 350 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcgaccaccacgccttgagcgactac

SEQ ID NO: 34059 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaaccggcgtctgggtcatagcccacgagtgcggccaccacgccttcagcgactac

SEQ ID NO: 34060 - DNA, 310 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtatagaactcaagaaagcaatcccaccgcactgtttcaaacgctcgatccctcgctctttctcctacctcatctgggacatcatcatagcctcctgcttctactacgtcgccaccacttacttccctctctcctacttcgcctggcctctctactgggcctgccaagggtgcgtcctaaccggcgtctgggtcatagcccacgagtgcggccaccacgccttcagcgactac

SEQ ID NO: 34061 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 34062 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcccctggcctctctactgggcctgccaagggtgcgtcctaaccggcgtctgggtcatatcccacgagtgcggccaccacgccttcagcgactac

SEQ ID NO: 34063 - DNA, 344 bp, Artificial
  Mutation in BnaC.FAD2.a introduced by TALE nuclease pair BnFAD2_T03
caggatcctgggtgcaggtggaagaatgcaagtgtctcctccctccaagaagtctgaaaccgacaccatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34064 - DNA, 342 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatagcccacgagtgcggccaccacgccttcagcgactac

SEQ ID NO: 34065 - DNA, 403 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcgaaccttcggtttgatcttctcctgttgctcggctatgtgccaggccatgctagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34066 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgcctggcctctctactgggcctgccaagggtgcgtcctaaccggcgtctgggtcatagcccacgagtgcggccaccacgccttcagcgactac

SEQ ID NO: 34067 - DNA, 334 bp, Artificial
  Mutation in BnaC.FAD2.a introduced by TALE nuclease pair BnFAD2_T03
gaggatccatgggtgcaggtggaagaatgcaagtctctcctccctccagctcggacttcaccagctgggaacggctgataggatcccccaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34068 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34069 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttccccatcaagaaagcaatcccaccgcactgtttcaaacgctcgatccctcgctctttctcatacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccgtcagcgactac

SEQ ID NO: 34070 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggtctgccaaggctgcgtcctaacgggcctctgggtcatagcccacgagtgcggccaccacgccttcagcgactac

SEQ ID NO: 34071 - DNA, 379 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggttccatagcgttaaggtttcatttagcgcctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34072 - DNA, 354 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacggtggtttgtttgccggagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgacta

SEQ ID NO: 34073 - DNA, 404 bp, Artificial
  Mutation in BnaC.FAD2.a introduced by TALE nuclease pair BnFAD2_T03
caggatccatgggtgcaggtggaagaatgcaagtctctactccctcaagctcccccggaaccaacaccctaaaacgcgtcccctgcgagacaccacccttcactcttgctggcgatggccaccacctgctggggggtcaagccgtgggcctggcacagcaccggcaacagccgctggacccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagccccccagtgcggccaccacgccttgagcgactac

SEQ ID NO: 34074 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccaccgcactgtttcaaacgctcgatccctcgctctttctcctacctcatctgggacatcatcatagcctcctgcttctactacgtcgccaccactcacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34075 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34076 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagagctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34077 - DNA, 340 bp, Artificial
  Mutation in BnaC.FAD2.a introduced by TALE nuclease pair BnFAD2_T03
caggatccatgggtgcaggtggaagaatgcaagtctcacctccctccagctcccccgaaaccaaaaccctcaaacgcgtcccctgcgagacaccaccattcactctttagcaatcccaccgcactgtttcaaacgctcgatccctcgctctttctcctccctcatctgggacatcatcatagcctcatgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 34078 - DNA, 329 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaccatcaagaaagcaatcccaccgcactgtttcaaacgctcgatccctcgctctttctcctacctcatctgggacatcatcatagcctcctgcttctactacgtcgccaccacttacttccctctcccttacctcgcctgacccctctactgggcctgccaaggctgcgtcctaacgggcctctgggtcatcgcccacgaatgcggccaccacgccttcagcgactac

SEQ ID NO: 34079 - DNA, 349 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacggggcctgccaagggtgcgtcctaaccggcgtcggggtcaaagcccacgagtgcggccaccacgccttcagcgactac

SEQ ID NO: 34080 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 34081 - DNA, 411 bp, Artificial
  Mutation in BnaC.FAD2.a introduced by TALE nuclease pair BnFAD2_T03
caggatccatgggtgcaggtggaagaatgcaagtctctactccctccagctcccccgaaaccaaaaccctcaaacgcgtcccctgcgagacaccgcccttcactgtcggcctggaacagcaccggcaacagccgctggaccgtctccagcgcctgcttgccaccgccagaactcaagaaagcaatcccaccgcactgtttcaaacgctcgatccctcgctctttctcctacctcatctgggacatcatcatagcctcctgcttctactacgtcgccacctcgtacttccctctcctccctcaccctctctcctgctgcgcctggcctctctactgggcctgccaagggtgcggcataaccggcgtctgggtcatagcccacgagtgcggccaccacgccttcagcgactac

SEQ ID NO: 34082 - DNA, 349 bp, Artificial
  Mutation in BnaC.FAD2.a introduced by TALE nuclease pair BnFAD2_T03
caggatccatgggcgcaggtgacagaattcaagtctctactccctccagctcccccgaaaccaacaccatcaaacgcgtcccctgcgagccaccacccttcactcagacctcaagaaagcaatcccaccgcactgtttcaaacgctcgatccctcgctctttctcctacctcatctgggacatcctcatagcctcctgcttctactacgtcgccaccacttacttccctctcctccctcaccctctctcctacttcgcctggcctctctactgggcctgccaagggtgcgtcctaaccggcgtcggggtcaaagcccacgagtgcggccaccacgcctgcagcgactac

SEQ ID NO: 34083 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacaagaaagcaatcccaccgcactgtttcaaacgctcgatccctcgctctttctcctacctcatctgggacatcatcatagcctcatgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34084 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcctctgggtcatagcccacgagtgcggccaccacgccttcagcgactac

SEQ ID NO: 34085 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacagtaactcaagaaagcaatcccaccgcactgtttcaaacgctcgatccctcgctctttctcctacctcatctgggacataatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 34086 - DNA, 448 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccccagcaggtggtgaccatcgccagcaataatggtggcaagccagcggctgttgccggtgctgtgccaggcccacggcttgaccccccagcaggggggggccatcgccagcaaaactcaacaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34087 - DNA, 347 bp, Artificial
  Mutation in BnaC.FAD2.a introduced by TALE nuclease pair BnFAD2_T03
caggatccatgggtgcaggtggaagaatgcaagtctctcctccctccaaaaagtctgaaaccgacatcatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34088 - DNA, 352 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagtgtgcgtcctaaccggcgtctgggtcatagcccacgagtgcggccaccacgccttcagcgactac

SEQ ID NO: 34089 - DNA, 350 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagttcggccaccacgccttcagcgactac

SEQ ID NO: 34090 - DNA, 348 bp, Artificial
  Mutation in BnaC.FAD2.a introduced by TALE nuclease pair BnFAD2_T03
caggatccatgggtgcaggtggaagaatgcaagtgtctcctcccctcaagaagtctgaaaccgataccatcaagcgcgtaccctgtgagacaccgtccttcactagaactcaagaaagtaatcccaccgcactgcttcaaccgctcgttcccttgctccttctcccacctcagctgggacatcatcatagcctcctgctcctactacgtcgccaccacttacttctctctcctcccccaccctctctcctacgtcgcctggcctctctactgggcctgccagggatgcgtcctaaccggcgtctgggtcatagcccaccagttcggccaccacgcctgcagcgactac

SEQ ID NO: 34091 - DNA, 347 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccactccttcagcgactac

SEQ ID NO: 34092 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34093 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccaccacactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34094 - DNA, 448 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagcgcctgcttgccgccatcgtggctggcgatggccaccacctgctccggggtcaagccgtgggcctggcacagcaccggcaacagccgctggacggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34095 - DNA, 317 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcacgtaccctgcgagacaccgcccttcactgtcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 34096 - DNA, 462 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgccataaactgccaggcatcaaactaagcagaaggccatccgtctccagcgcctgcttgccaccgccattgccaggcccacggcttgaccccccagcaggtggtggccattagaactcaagaaagcaatcccaccgcactgtttcaaacgcgcgagccctcgctctttcgcctacctcagctgggacatcatcatagcctcctgcttctactacggcgccaccacttacttccctctcctccctcaccctctctcctacttcgcctggcctctctactgggcctgccaagggtgcgtcctaaccggcgtctgggtcatagcccacgagtgcggccaccacgccttcagctactac

SEQ ID NO: 34097 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcatacttcgcctggcctctctactgggcctgccaagggtgcgtcctaaccggcgtctgggtcatagcccaggagtgcggccaccacgccttcagcgactac

SEQ ID NO: 34098 - DNA, 342 bp, Artificial
  Mutation in BnaC.FAD2.a introduced by TALE nuclease pair BnFAD2_T03
caggatccatgggtgcaggtggaagaatgcaagtctctcctccctccagctccccctaaaccaaaaccctcaaacgcgtcccctgcgagacaccacccttcactcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34099 - DNA, 443 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggtcataatgtttttggtacaaccgatttagctttatgctctgaggcttagaccgagatagggttgagtgttgttccagtttggaacaagagtccactatttaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34100 - DNA, 352 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtggagaactcaagaaagcaatcccaccgcactggttcaaacgctcgatccctcgctctttctcctacctcatctgggacatcatcatagcctcctgcttctactacgtcgccccctctcacttccctctcctccctcaccctctcccctacctcgcctggcctctctactgggcctgccaagggtgcgtcctaacgggcctctgggtcatcgcccacgaatgcggccaccacgccttcagcgactac

SEQ ID NO: 34101 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcataacctcctgcttctactacgtcgccaccacttacttccctctcctccctcaccctctctcctacctcgcctgacccctctactgggcctgccaaggctgcgtcctaacgggcctctgggtcatagcccacgagtgcggccaccacgccttcagcgactac

SEQ ID NO: 34102 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 34103 - DNA, 336 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 34104 - DNA, 316 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 34105 - DNA, 347 bp, Artificial
  Mutation in BnaC.FAD2.a introduced by TALE nuclease pair BnFAD2_T03
caggatccatgggtgcaggtggaagaatgcaagtctctcctccctcccagaagtctgaaaccgacaccatcaagcgcgtaccctgcgcgacaccgcccttcacttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgcctggcctctctactgggcctgccaaggctgcgtcctaacgggcctctgggtcatcgcccacgaatgcggccaccacgccttcagcgactac

SEQ ID NO: 34106 - DNA, 342 bp, Artificial
  Mutation in BnaC.FAD2.a introduced by TALE nuclease pair BnFAD2_T03
caggatccatgggtgcaggtggaagaatgcaagtgtctcctccatccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34107 - DNA, 346 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34108 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctctatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34109 - DNA, 352 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtggagaactcaagaaagcaatcccaccgcactgtttcaaacgctcgatccctcgctctttctcctacctcatctgggacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 34110 - DNA, 423 bp, Artificial
  Mutation in BnaC.FAD2.a introduced by TALE nuclease pair BnFAD2_T03
caggatccatgtgtgcaggtggaagaatgcaagtgtctcctccctccaagaagtctgaaaccgacaccatcaagcgcgtaccctgcgagacaccgcccttcactgtcggcgatggccaccacctgctccggggtcaagccgtgggcctggcacagcaccggcaacaggcgctggagactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 34111 - DNA, 479 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaatgtcattgcgctgccattctccaaattgcagttcgcgcttagctggataacgccacggaatgatgtcgtcgtgcacaacaatggtgacttctacagcgcggagaatctcgctctctccaggggaagccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34112 - DNA, 331 bp, Artificial
  Mutation in BnaC.FAD2.a introduced by TALE nuclease pair BnFAD2_T03
caggatccatgggtgcaggtggaagaatgcaagtctcacctccctccagctcccccgaaaccaaaaccctcaaacgcgtcccctgcgagacctcaagaaagcaatcccaccgcactgtttcaaacgctcgatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34113 - DNA, 347 bp, Artificial
  Mutation in BnaC.FAD2.a introduced by TALE nuclease pair BnFAD2_T03
caggatcatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 34114 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgagtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34115 - DNA, 352 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 34116 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34117 - DNA, 351 bp, Artificial
  Mutation in BnaC.FAD2.a introduced by TALE nuclease pair BnFAD2_T03
caggatccatgggtgcaggtggaagaatgcaagtctatcctccctccagctcccccggaaccaacaccctcaaccgcgtcccctgcgagacaccaccattcactctcagacctcaagaaagcaatcccacctcactgcttcaaacgctcgatccctcgctctttctcctacctcatctgggacatcatcatagcctcctgcttctactacgtcgccaccacttacttccctctcctccctcaccctctctccgacttcgcctggcctctctactgggccggccaagggtgcgtcctaaccggcgtcggggtcatagcccacgagtgcggccaccacgccttcagcgactac

SEQ ID NO: 34118 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggcaaccacgccttcagcgactac

SEQ ID NO: 34119 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtccgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34120 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccatggctgcgtcctaaccggcgtctgggtcatagcccacgagtgcggccaccacgccttcagcgactac

SEQ ID NO: 34121 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34122 - DNA, 349 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34123 - DNA, 338 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgctcaagaaagcaatcccaccgcactgttttaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 34124 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtacggccaccacgccttcagcgactac

SEQ ID NO: 34125 - DNA, 280 bp, Artificial
  Mutation in BnaC.FAD2.a introduced by TALE nuclease pair BnFAD2_T03
caggatccatgggtgcaggtggaagaatgcaagtctctcctccctccagctcccccgaaaccgacaccatcaagcgcgtaccctgcgagacaccgcccttcactgtcgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34126 - DNA, 350 bp, Artificial
  Mutation in BnaC.FAD2.a introduced by TALE nuclease pair BnFAD2_T03
caggatccatgggtgcaggcggaagaatgcaagtgtctcctccctccaagaagtctgaaaccgacaccatcaaacgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccccttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34127 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34128 - DNA, 357 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34129 - DNA, 354 bp, Artificial
  Mutation in BnaC.FAD2.a introduced by TALE nuclease pair BnFAD2_T03
caggatccatgggtgcaggtggaagaatgcaagtgtctcctccctccagctcccccggaaccaacaccctcaaacgcgtcccctgcgagacaccgcccttcactgtcgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34130 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcccctggcctctctactgggcctgccaagggtgcgtcctaaccggcgtctgggtcatagcccacgagtgcggccaccacgccttcagcgactac

SEQ ID NO: 34131 - DNA, 391 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacacccgcttcctcgctcactgactcgctgcgctcggtcgttcggctgcggcgagcggagaactcaagaaagcaaccccaccgcactgtttcaaacgctcgatccctcgctctttctcctacctcatctgggacatcatcatagcctcctgctgctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34132 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacacctccctccaagtgtctcctccctcccaccgcactgtttcaaacgctcgatccctcgctctttctcctacctcatctgggacatcatcatagcctcctgcttctgctacgtcgccaccacttacttccctctcctccctcaccctctctcctacttcccctggcctctctactgggcctgccaagggtgcgtcctaaccggcgtctgggtcatagcccacgagtgcggccaccacgccttcagcgactac

SEQ ID NO: 34133 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaactcaagaaagcaatcccaccacactgtttcaaacgctcgatccctcgctctttctcctacctcatctgggacatcatcatagcctcctgcttctactacgtcgccaccacttacttccctctcctccctcaccctctctccaacttcgcctggcctctctactgggcctgccaagggtgcgtcctaaccggcgtctgggtcatagcccacgagtgcggccaccacgccttcagcgactac

SEQ ID NO: 34134 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatagcccacgagtgcggccaccacgccttcagcgactac

SEQ ID NO: 34135 - DNA, 331 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgccagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34136 - DNA, 370 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 34137 - DNA, 334 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 34138 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactacc

SEQ ID NO: 34139 - DNA, 471 bp, Artificial
  Mutation in BnaC.FAD2.a introduced by TALE nuclease pair BnFAD2_T03
caggatccatgggtgcaggtggaagaatgcaagtctctcctccctccagctcccccggaaccgacaccatcaagcgcgtaccctgcgagacaccgcccttcactgtctattgctggcgatggccaccacctgctggggggtcaagccgtgggcctggcacagcaccggcaaaggccatccgtcaggatggccttctgcttagtttgatgcctggcagtttatggcggagaactcaagaaagcaatcccaccgcactgtttcaaacgctcgatccctcgctctttctcctacctcatctgggacatcatcatggcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34140 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 34141 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 34142 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34143 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 34144 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34145 - DNA, 332 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 34146 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 34147 - DNA, 347 bp, Artificial
  Mutation in BnaC.FAD2.a introduced by TALE nuclease pair BnFAD2_T03
caggatccatgggtgcaggcggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccatcagcgactac

SEQ ID NO: 34148 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 34149 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 34150 - DNA, 444 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgtgggcctggcacagcaccggcaacagcgcctgcaccgtctccagcgctggtttgccaccaatattgctggcgatggccaccacctgctacggagaactcaagaaagcaatcccaccgcactgtttcaaacgctcgatccctcgctctttctcctacctcatctggtacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34151 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgtttcaaacgctcgatccctcgctctttctcctacctcatctgggacatcatcatagcctcctgcttctactacgtcgccaccacttacttccctctcctccatcaccctctctcctacttcgcctggcctctctactgggcctgccaagggtgcgtcctaaccggcgtctgggtcatagcccacgagtgcggccaccacgccttcagcgactac

SEQ ID NO: 34152 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacatcgcctggcctctctactgggcctgccaagggtgcgtccgaaccggcgtcggggtcatagcccacgagtgcggccaccacgccttcagcgactac

SEQ ID NO: 34153 - DNA, 346 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34154 - DNA, 318 bp, Artificial
  Mutation in BnaC.FAD2.a introduced by TALE nuclease pair BnFAD2_T03
caggatccatgggtgcaggtgcaagaatgcaagtgcctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgtggccaccacgccttcagcgactc

SEQ ID NO: 34155 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccaagggtgcgtcctaaccggcgtctgggtcatagcccacgagtgcggccaccacgccttcagcgactac

SEQ ID NO: 34156 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 34157 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 34158 - DNA, 348 bp, Artificial
  Mutation in BnaC.FAD2.a introduced by TALE nuclease pair BnFAD2_T03
caggatccatgggtgcaggtggaagaatgcaagtgtctcatccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 34159 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgcctcagcgactac

SEQ ID NO: 34160 - DNA, 405 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcaacagccgctggaccgtctccagcgcctgcttgccaccattattgctggcgagaactcaagaaagcaatcccaccgcactgtttcaaacgctcgatccctcgctctttctcctacctcatcttggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34161 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 34162 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgcagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 34163 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccaacaccatcaagcgcgtaccctgcgagacaccgcccttcactgtcgacggagaactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 34164 - DNA, 421 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtgcaccggcaacagccgctggaccgtctccagcgcctgcttgccgccatcgtggctggcgatggccaccacctgaacccaagaaagcaatcccaccgcactgtttcaaacgctcgatccctcgctctttctcctacctcatctggggcatcatcatggcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34165 - DNA, 339 bp, Artificial
  Mutation in BnaC.FAD2.a introduced by TALE nuclease pair BnFAD2_T03
caggatccatgggtgcaggtggaagaatgcaagtgtctcctccctccaagaagcctgaaaccgacaccatcaagcgcgtaccctgcgagacaccgccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34166 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 34167 - DNA, 354 bp, Artificial
  Mutation in BnaC.FAD2.a introduced by TALE nuclease pair BnFAD2_T03
caggatccatgggtgcaggtggaagaatgcaagtgtctcctccatccaagaagtctgaaaccgacaccatcaagcgcgtaccctgcgagacaccgcccttcactgtcgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 34168 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggctaccacgccttcagcgactac

SEQ ID NO: 34169 - DNA, 350 bp, Artificial
  Mutation in BnaC.FAD2.a introduced by TALE nuclease pair BnFAD2_T03
caggatccatgggtgcaggtcgaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 34170 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcagaactcaagaaagcaatcccaccgcactgtttcaaacgctcgatccctcactctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 34171 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 34172 - DNA, 372 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagcggctgttgccggtgctgtgccaggcccccgctcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34173 - DNA, 348 bp, Artificial
  Mutation in BnaC.FAD2.a introduced by TALE nuclease pair BnFAD2_T03
caggatccatgggtgcaggtggaagaatgtaagtctctcctccctccagctcccccgaaaccaaaaccctcaaacgcgtcccctgcgagacaccacccttcactcgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgcctggcctctctactgggcctgccaagggtgcgtcctaaccggcgtctgggtcatagcccacgagtgcggccaccacgccttcagcgactac

SEQ ID NO: 34174 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttaaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 34175 - DNA, 287 bp, Artificial
  Mutation in BnaC.FAD2.a introduced by TALE nuclease pair BnFAD2_T03
caggatccattggtgcaggtggaagaatgcaagtgtctcctccctccaagaagtctgaaaccgacaccatcaagcgcgtaccctgcgagacacagcccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34176 - DNA, 350 bp, Artificial
  Mutation in BnaC.FAD2.a introduced by TALE nuclease pair BnFAD2_T03
caggatccatgggtgcaggtgaaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcggggtcatagcccacgagtgcggccaccacgccttcagcgactac

SEQ ID NO: 34177 - DNA, 349 bp, Artificial
  Mutation in BnaC.FAD2.a introduced by TALE nuclease pair BnFAD2_T03
caggatccatgggtgcaggtggaagaatgcaagtgcctcctccctccaagaagtctgaaaccgacaccatccagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaatggtgcgtcctaaccggcgtctgggtcatagcccacgagtgcggccaccacgccttcagcgactac

SEQ ID NO: 34178 - DNA, 387 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgcgttatcccctgattctgtggataaccgtattaccgagacctcaagaaagcaatcccaccgcactgtttcaaacgctcgatccctcgctctttctcctacctcatctgggacatcatcatagcctcctgcttctactacgtcgccaccacttacttccctctcctccctccccctctctcctacttcgcctggcctctctactgggcctgccaagggtgcgtcctaaccggcgtctgggtcatagcccacgagtgcggccaccacgccttcagcgactac

SEQ ID NO: 34179 - DNA, 280 bp, Artificial
  Mutation in BnaC.FAD2.a introduced by TALE nuclease pair BnFAD2_T03
caggatccatgggtgcaggtggaagaatgcaagtgtctcctccctcaaagaagtctgaaaccgacaccatcaagcgcgtaccctgcgagacaccgcccttcactgtcgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgattgcggccaccacaccttcagcgactac

SEQ ID NO: 34180 - DNA, 402 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggggtcaagccgtgggcctggcacagcaccggcaagcaggcgctggagacgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34181 - DNA, 419 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttgtccagcggctgttgccggtgctgtgccaggcccacggcttgacccctcagcaggtggtggccatcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 34182 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34183 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctttagcgactac

SEQ ID NO: 34184 - DNA, 345 bp, Artificial
  Mutation in BnaC.FAD2.a introduced by TALE nuclease pair BnFAD2_T03
caggatccatgggtgcaggtggaagaatccaagtgtctcctccctccaagaagtctgaaaccgacaccatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34185 - DNA, 347 bp, Artificial
  Mutation in BnaC.FAD2.a introduced by TALE nuclease pair BnFAD2_T03
caggatccatgggtgcaggtggaagaatgcaagtgtctcccccctccaaaaagtctgaaaccgacaccatcaagcgcgtaccctgcgagacaccgcccttcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagccctcgagtgcggccaccacgccgtcagcgactac

SEQ ID NO: 34186 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctcgcctctctactgggcctgccaagggtgcgtcctaaccggcgtctgggtcatagcccacgagtgcggccaccacgccttcagcgactac

SEQ ID NO: 34187 - DNA, 381 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactttcgaggcattcctgtcctggctggtctagaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggccgctctactgggcctgccaagggtgcgtcctaaccggcgtctgtgtcatagcccacgagtgcggccaccacgccttcagcgactac

SEQ ID NO: 34188 - DNA, 342 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcttcctaaccggcgtctgggtcatagcccacgagtgctgccaccacgccttcagcgactac

SEQ ID NO: 34189 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcatgccaagggtgagtcctaaccggcgtctgggtcatagcccacgagtgcgcccaccacgccttcagcgactac

SEQ ID NO: 34190 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgcaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 34191 - DNA, 347 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctactcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34192 - DNA, 359 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgtctccagcgccagaactcaagaaagcaatcccaccgcactgttttaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34193 - DNA, 389 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggtttgtttgccggatcaagagctaccaactctttttccgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcttggtcatagcccacgagtgcggccaccacgccttcagcgactac

SEQ ID NO: 34194 - DNA, 277 bp, Artificial
  Mutation in BnaC.FAD2.a introduced by TALE nuclease pair BnFAD2_T03
caggatccatgggtgcaggtggaagaatgcaagtgtctccttcctccaaaaagtctgaaaccgacaccatcaagcgcgtaccctgcgagacaccgcccttcactgtcgatcgagcgtttgaaacagtgcggtgggattgctttcttgagttctccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34195 - DNA, 338 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcagccaccacgccctcagcgactac

SEQ ID NO: 34196 - DNA, 341 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccagaactcaagatagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34197 - DNA, 280 bp, Artificial
  Mutation in BnaC.FAD2.a introduced by TALE nuclease pair BnFAD2_T03
caggatccatgggtgcagggggaagaatgcaagtgtctcctccctccaagaagtctgaaaccgacaccatcaagcgcgtaccctgcgagacaccgcccttcactgtcgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34198 - DNA, 347 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtaccctgcgagacaccgcccttcactgaactcaagaaagcaatcccaccgcactgtttcaaacgctcaatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34199 - DNA, 428 bp, Artificial
  Mutation in BnaC.FAD2.a introduced by TALE nuclease pair BnFAD2_T03
caggatccatgggtgcaggtggaagaatgcaagtctctcctcactccagctcccccggaaccaacaccctcaaacgcgtcccctgcgagacaccaccattcactggcacagcaccggcaacagccgctggaccgtcaggatggccttctgcttagtttgatgcctggcagtttatggcgggcaggaaactcaagaaagcaatcccacctcactgcttcaaacgctcgatccctcgctctttctcctacctcatctgggacatcatcatagcctcctgcttctactacgtcgccaccacttacttccctctcctccctccccctctctcctacttcgcctggcctctctactgggcctgccaagggtgcgtcctaaccggcgtctgggtcatagcccacgagtgcggccaccacgccttcagcgactac

SEQ ID NO: 34200 - DNA, 345 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacccctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34201 - DNA, 444 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggaccgtctccagcgcctgcttgccaccattattgctggcgatggccaccacctgctggggggtcaagccgtgggcctggcacagcaccggcaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34202 - DNA, 380 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcatctagatccaatgatcatgagcggagaattaaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34203 - DNA, 350 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccatcagcgactac

SEQ ID NO: 34204 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctcccctccctcaccctctctcctacttcgcctggcctctctactgggcctgccaagggtgcgtcctaacgggcctctgggtcatagcccacgagtgcggccaccacgccttcagcgactac

SEQ ID NO: 34205 - DNA, 382 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacagccgctggaccgtctccagcgcctgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34206 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaaactcaagaaagcaatcccaccgcactgtttcaaacgctcgatccctcgctctttctcctacctcatctgggacatcatcatagcctcctgcttctactacgtcgccaccacttacttccctctcctccctcgccctctctcctacttcgcctggcctctctactgggcctgccaagggtgcgtcctaaccggcgtctgggtcatagcccacgagtgcggccaccacgccttcagcgactac

SEQ ID NO: 34207 - DNA, 378 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacttttggagcagcaacgatgttacgcagcaggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccgcgagtgcggccaccacgccttcagcgactac

SEQ ID NO: 34208 - DNA, 354 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggccatagcccacgagtgcggccaccacgccttcagcgactac

SEQ ID NO: 34209 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34210 - DNA, 377 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacacccgcttcctcgctcactgactcgctgcgctcggtcgttcggctgcggcgagcggagaactcaagaaagcaatcccaccgcactgtttcaaacgctcgatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 34211 - DNA, 346 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34212 - DNA, 349 bp, Artificial
  Mutation in BnaC.FAD2.a introduced by TALE nuclease pair BnFAD2_T03
caggatccatgggtgcaggtggaagaatgcaagtgtcacctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34213 - DNA, 346 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 34214 - DNA, 405 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcggcaacagccgctggaccgtctccagcgcctgcttgccaccattattgctggcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34215 - DNA, 271 bp, Artificial
  Mutation in BnaC.FAD2.a introduced by TALE nuclease pair BnFAD2_T03
caggatccatgggtgcaggtggaagaatgcaagtgtctcctccctcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 34216 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctctatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34217 - DNA, 376 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcacgactac

SEQ ID NO: 34218 - DNA, 346 bp, Artificial
  Mutation in BnaC.FAD2.a introduced by TALE nuclease pair BnFAD2_T03
caggatccatgggtgcaggtggaagaatgcaagtctctcctccctcaagctccaccgaaaccaaaaccctcaaacgcgtcccctgcgagacaccacccttcactacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34219 - DNA, 436 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgggcttgaccccccagcaggtggtggccatcgccagcaataatggtggcaagcaggcgctggagacggtccagcggctgttgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34220 - DNA, 425 bp, Artificial
  Mutation in BnaC.FAD2.a introduced by TALE nuclease pair BnFAD2_T03
caggatccatgcgtgcaggtggaagaatgcaagtgtctcctccctccaagaagtctgaaaccgacaccatcaagcgcgtaccctgcgagacaccgcccttcactgttagttcggttcgttcgacagtggcgcagcaccacgaggcactggtcggccacgggtttacacacgcgcacaagaaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccctcagcgactac

SEQ ID NO: 34221 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagcctgaaaccgacaacatcaagcgcgtaccctgcgagacaccacccttcactcagacctcaagaaagcaatcccaccgcactgtttcaaactctcgatccctcgctctttctcctacctcatctgggacatcatcatagcctcctgcttctactacgtcgccccctcctacttccctctcctcccccaccctctctcctacctcgcctggcctctctactgggcctgccaagggtgcgtcctaaccggcgtctgggtcatagcccacgagtgcggccaccacgccttcagcgactac

SEQ ID NO: 34222 - DNA, 436 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgggcttgaccccccagcaggtggtggccatcgccagcaataatggtggcaagcaggcgctggagacggtccagcggctgttgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 34223 - DNA, 377 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgcggcgggtgtggtgggttcgcgcaaagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34224 - DNA, 348 bp, Artificial
  Mutation in BnaC.FAD2.a introduced by TALE nuclease pair BnFAD2_T03
caggatccatgggtgcaggtggaagaatgcaagtctctcctcccgccagctcccccgaaaccaaaaccctcaaacgcgtcccctgcgagacaccacccttcactcgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctgctgggcctgccaagggtgcgtcctagccgacgtctgggtcatagccctcgagtgcggccaccgcaccatcagcaactac

SEQ ID NO: 34225 - DNA, 415 bp, Artificial
  Mutation in BnaC.FAD2.a introduced by TALE nuclease pair BnFAD2_T03
caggatccatgggtgcaggtggaagaattcaagtctctcctccctccagctcccccgaaaccaaaaccctcaaacgcgtcccctgcgagacaccacccttcactctcgccagccacgatggcggcaagcaggcgctggagacggtccagcggctggtgccggtgctgtgccagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34226 - DNA, 337 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 34227 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacagggcctgccaagggtgcggccgaaccggcgtctgggtcatagcccacgagtgcggccaccacgccatcagcgactac

SEQ ID NO: 34228 - DNA, 471 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtatccagcgcctgcttgccaccattattgctggcgatggccaccacctgctggggggtcaagccgtgggcctggcacagcaccggcaacagccgctggaccgtctccagcgcctgcttgccgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34229 - DNA, 415 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgatgggcaggttgtagccgccggagcaggccttggcgtccacgatcacgccgtagtcgatggggatacctcaagaaagcaatcccaccgcactgtttcaaacgctcgatccctcgctctttctcctacctcatctgggacatcagcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34230 - DNA, 346 bp, Artificial
  Mutation in BnaC.FAD2.a introduced by TALE nuclease pair BnFAD2_T03
caggatccatgggtgcaggtggaagaatgcaagtgtctcctccctccagctcccccggaaccaacaccctcaaacgcgtcccctgcgagacaccacccttcaagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34231 - DNA, 344 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccaagagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34232 - DNA, 341 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34233 - DNA, 305 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccatcagcgactac

SEQ ID NO: 34234 - DNA, 419 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccggtccagcggctgttgccgccatcgtggctggcgatggccaccacctgctccggggtcaagccgtgggcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34235 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgttccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 34236 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccatgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccatcagcgactac

SEQ ID NO: 34237 - DNA, 349 bp, Artificial
  Mutation in BnaC.FAD2.a introduced by TALE nuclease pair BnFAD2_T03
caggatccatgggtgcaggtggaagaatgcaagtgtctccccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgctgccaccacgccttcagcgactac

SEQ ID NO: 34238 - DNA, 342 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactcaagaaagcaatcccaccgcactgtttcaaacgctcgatccctcgctctttcccctacctctcctgggacatcttcatagcctcctgcttctactacgtcgccaccacttacttccctctcctccctcaccctctctcctacttcgcctggcccctctactgggcctgccaagggtgcgtcctaaccggcgtctgggtcatagcccgcgagtgcggccaccacgccttcagcgactac

SEQ ID NO: 34239 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcgcgactac

SEQ ID NO: 34240 - DNA, 332 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaggggtgcgtcctaacgggcctctgggtcatagcccacgagtgcggccaccacgccttcagcgactac

SEQ ID NO: 34241 - DNA, 314 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgagtgcggccaccacgccgtcagcgactac

SEQ ID NO: 34242 - DNA, 356 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcataaccggcgtctgggtcatagcccacgagtgcggccaccacgccttcagcgactac

SEQ ID NO: 34243 - DNA, 317 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatacgcaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34244 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34245 - DNA, 308 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34246 - DNA, 308 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacactggagacggtctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34247 - DNA, 382 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacagccgctggaccgtctccagcgcctgtcggagaactcaagaaagcaatcccaccgcactgtttcaaacgctcgatccctcgctctttctcctacctcatctgggacatcatcatagcctcctgcttctactacgtcgccaccacttacttccctctccgccctcaccctctctcctacttcgcctggcctctctactgggcctgccaagggtgcgtcctaaccggcgtctgggtcatagcccacgagtgcggccaccacgccttcagcgactac

SEQ ID NO: 34248 - DNA, 319 bp, Artificial
  Mutation in BnaC.FAD2.a introduced by TALE nuclease pair BnFAD2_T03
caggatccatgggtgcaggtggaagaattcaagtgtctcctccctccaagaagtctgaaaccgacaccatcaagcgcgtaccctgcgagacaccacccttcactgtttcaaacgctcgacccctcgctctttcttctacctcatctgggacatcatcatagcctcctgcttctactacgtcgccaccacttacttccctctcctccctcaccctctctcctacttcgcctggcctctttactgggcctgctaagggtgcgtcctaaccggcgtctgggtcatagcccacgagtgcggccaccacgccttcagcgactac

SEQ ID NO: 34249 - DNA, 419 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttgtccagcggctgttgccggtgctgtgccaggcccacggcttgacccctcagcaggtggtggccatcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 34250 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactatacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34251 - DNA, 436 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacggtccagcggctgttgccggtgctgtgccaggcccacggcttgaccccccagcaggtggtggccatcgccagcaatggcggtggcacggagaactcaacaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 34252 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccgacaccatcaagcgcgtaccctgcgagacaccgcccttcactgagaactcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34253 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctgagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34254 - DNA, 433 bp, Artificial
  Mutation in BnaC.FAD2.a introduced by TALE nuclease pair BnFAD2_T03
caggatccatgggtgcaggtggaagaatacaagtctctcctccctccagctcccccggaaccaacaccctcaaacgcgtcccctgcgagacaccaccattcactctcggcaacagccgctggaccgtctccagcgcctgcttgccaccattattgctggcgatggccaccacctgccatcccacgttccagaactcaagaaagcaatcccaccgcactgtttcaaacgctcgatccctcgctctttctcctacctcagctggtacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34255 - DNA, 459 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgtctccagcggctgttgccggtgctgtgccaggcccacggcttgaccctcagcaggtggtggccatcgccagcaatggcggtggcaagcaggcgctggagacggtccagcggagaactcaagaaagcaatcccaccgcactgtttcaaacgctcgatccctcgctctttctcctacctcatctgggacatcatcatagcctcctgcttctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 34256 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccatctcctccctcaccctctatcctacttcgcctggcctctctactgggcctgccaaggctgcgtcctaaccggcgtctgggtcatagcccacgagtgcggccaccacgccttcagcgactac

SEQ ID NO: 34257 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaattcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 34258 - DNA, 316 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 34259 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaataaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34260 - DNA, 408 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttggccaccacctgctccggggtcaagctggaggggtacaccttccaccactcgttgggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 34261 - DNA, 342 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34262 - DNA, 440 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggggagaaaggcggacaggtatccggtaagcggcagggtcggaacagccgctggaccgtctccagcgcctgcttgccaccattattgctggccctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 34263 - DNA, 326 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34264 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 34265 - DNA, 368 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagcaatggcggtggctggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggtccctctactgggcctgccaaggctgcgtcctaacgggcctctgggtcatcgcccacgaatgcggccaccacgccttcagcgactac

SEQ ID NO: 34266 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccatcaccctctctcctacttcgcctggcctctctactgggcctgccaagggtgcgtcctaaccggcgtctgggtcatagcccacgagtgcggccaccacgccttcagcgactac

SEQ ID NO: 34267 - DNA, 350 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgctgcgcctggcctctctactgggcctgccaagggtgcggcctaaccggcgtctgggtcatagcccgcgagtgcggccaccacaccatcagcgactac

SEQ ID NO: 34268 - DNA, 336 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 34269 - DNA, 336 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 34270 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccgcgaatgcggccaccacgccttcagcgactac

SEQ ID NO: 34271 - DNA, 348 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcaacatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34272 - DNA, 409 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaggcccacggcttgaccccggagcaggtggtggccatcgccagcaatattggtggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 34273 - DNA, 335 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacacacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34274 - DNA, 436 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgggcttgaccccccagcaggtggtggccatcgccagcaataatggtggcaagcaggcgctggagacggtccagcggctgttgccggagaactcaagaaagcaatcccaccgcactgtttcaaacgctcgatccctcgctctttctcctaccacagctgggacatcatcatagcctcctgctacaactacggcgccaccactaacagcccgctcctccctcaccctctcgcctacttcgcctggcctctctactgggcctgccaagggtgcgtcctaaccggcgtctgggtcatagcccacgagtgcggccaccacgccatcagcgactac

SEQ ID NO: 34275 - DNA, 331 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccaccgcactgtttcaaacgctcgatccctcgctctttctcctacttcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 34276 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatcttggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34277 - DNA, 331 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaactcaagaaagcaatcccaccgcactgtatcaaacgctcgatccctcgctctttctcctacctcatctgggacatcatcatagcctcctgcttctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 34278 - DNA, 342 bp, Artificial
  Mutation in BnaC.FAD2.a introduced by TALE nuclease pair BnFAD2_T03
caggatccatgggtgcaggtggaagaatgcaagtgtctcccccctccaagaagtctgaaaccgacaccatcaagcgcgtaccctgcgagacaccgcccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34279 - DNA, 347 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgtgtcctaaccggcgtctgggtcatagcccacgagtgcggccaccacgccttcagcgactac

SEQ ID NO: 34280 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaatcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagccgacgagtgcggccaccatgccatcaacgactac

SEQ ID NO: 34281 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctcgatccctcgctctttctcctacctcatctgggacatcctcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34282 - DNA, 282 bp, Artificial
  Mutation in BnaC.FAD2.a introduced by TALE nuclease pair BnFAD2_T03
caggatccatgggtgcaggtggaagaatgcaagtctctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccttgcctctctactgggcctgccaagggtgcgtcctaaccggcgtctgggtcatagcccacgagtgcggccaccacgccttcagcgactac

SEQ ID NO: 34283 - DNA, 343 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcctctgggtcatagcccacgagtgcggccaccacgccttcagcgactac

SEQ ID NO: 34284 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34285 - DNA, 368 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgtagcaatggcggtggctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 34286 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactttttcaaacgctcgatccctcgctctttctcctacctcatctgggacatcattatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34287 - DNA, 287 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttctcctacctcatctgggacatcatcatagcctcctgcttctactacgtcgccaccacttacttccctctcctccctcaccctctctcctacttcgcctggcctctctactgggcctgccaagggtgcgtcctaaccgtcgtctgggtcatagcccacgagtgcggccaccacgccttcagcgactac

SEQ ID NO: 34288 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 34289 - DNA, 423 bp, Artificial
  Mutation in BnaC.FAD2.a introduced by TALE nuclease pair BnFAD2_T03
caggatccatgggtgcaggtggaagaatgcaagtgtctcgaccttaaaagaagactgacaccgcccccatcaagagcgtccactgcgcgacaccgctcttacctgccggcgatggccaccacctcctccggggtcaagcagtgggccagacccagcaccggccacagccgccggcgactagaactcaagaaagcaatcccaccgcactgtttcaaacgctccatccctcgctctttctcctacctcatctgcgacatcatcatctcctcctccttctaccacctcgccaccgcctacttccctctcctccctcaccctctctcttacttcgcctggcctctctactgggcctgccaagggtgcgtcctaaccggcgtctgggtcatagcccacgagtgcggccaccacgccttcagcgactac

SEQ ID NO: 34290 - DNA, 315 bp, Artificial
  Mutation in BnaC.FAD2.a introduced by TALE nuclease pair BnFAD2_T03
caggatccatgggtgcaggtggaagaatgcaagtctctcctccctccagctcccccggaaacaacaccctcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34291 - DNA, 376 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggttacgtgccccacgagtacatctagctgagcgagatcgcccggaacagcactgtttcaaacgctcgatccctcgctctttctcctacctcatctgtgacatcatcatagcctcctgcttctactacgtcgccaccacttacttccctctcctccccccccctctcccttacctcgcctggcccctctactgggcctgccaaggctgcgtcctaacgggcctctgggtcatagcccacgagtgcggccaccacgccttcagcgactac

SEQ ID NO: 34292 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 34293 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 34294 - DNA, 349 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggtcaccacgccttcagcgactac

SEQ ID NO: 34295 - DNA, 299 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaaactcaagaaagcaatcccaccgcactgtttcaaacgctcgatccctcgctctttctcctacctcatctgggacatcatcatagcctcctgcttctactacgtcgccaccacttacttccctctcccttacctcgcctggcctctctactgggcctgccaagggtgcgtcctaaccggcgtctgggtcatagcccacgagtgcggccaccacgccttcagcgactac

SEQ ID NO: 34296 - DNA, 343 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaaacgcgtcccctgcgagacaccatcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34297 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcacaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34298 - DNA, 345 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34299 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 34300 - DNA, 329 bp, Artificial
  Mutation in BnaC.FAD2.a introduced by TALE nuclease pair BnFAD2_T03
catgatccatgggtgcaggtggaagaatgcaagtgtctcctccctccaagaagtctgaaaccgacaccatcaagcgcgtaccctgcgagacaccaactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 34301 - DNA, 344 bp, Artificial
  Mutation in BnaC.FAD2.a introduced by TALE nuclease pair BnFAD2_T03
caggatccatgggtgcaggtggaagaatgcaagtatctcctccctccaagaagtctgaaaccgacaccatcaagcgcgtaccctgcgagacaccgcccttcactgtaagaactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 34302 - DNA, 347 bp, Artificial
  Mutation in BnaC.FAD2.a introduced by TALE nuclease pair BnFAD2_T03
caggatccatgggtgcaggtggaagaatccagtgtctcccccctccaagaagtctgaaaccgacaccctccagcgcgtaccctgccggacaacgcccttcactgaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34303 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctcccctaccctctcccttacctcgcctggcccctctactgggcctgccaaggctgcgtcctaacgggcctctgggtcatcgcccacgaatgcggccaccacgccttcagcgactac

SEQ ID NO: 34304 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacactcaagaaagcaatcccaccgcactgtttcaaacgctcgatccctcgctctttctcctacctcatctgggacatcatcatagcctcctacttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34305 - DNA, 344 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactctcaagaaagcaatcccaccgcactgtttcaaacgctcgatccctcgctctttctcctacctcatctgggacatcatcatagcctcctgcttctactacgtcgccaccacttacttccctctcctccctcaccctatctcctacttcgcctggcctctctactgggcctgccaagggtgcgtcctaacgggcctctgggtcatagcccacgagtgcggccaccacgccttcagcgactac

SEQ ID NO: 34306 - DNA, 370 bp, Artificial
  Mutation in BnaC.FAD2.a introduced by TALE nuclease pair BnFAD2_T03
caggatccatgggtgcaggtggaagaatgcaagtgtctcctccctcccagaagtctgaaaccgacaccatcaagcgcgtaccctgcgagacaccgcccttcaatggcaagtaggcgctggagacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34307 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatagcccacgagtgcggccaccacgccttcagcgactac

SEQ ID NO: 34308 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgcctggcctctctactgggcctgccaagggtgcgtcctaaccggcgtctgggtcatagcccacgagggcggccaccacgccttcagcgactac

SEQ ID NO: 34309 - DNA, 395 bp, Artificial
  Mutation in BnaC.FAD2.a introduced by TALE nuclease pair BnFAD2_T03
caggatccatgggtgcaggtgcaagaatgcaagtgtctactcactccaagaagtctgaaaccgacaccatcaagcgcgtaccctgcgagacaccgcccttcactggtggccatcgccagcaatggcggtggcaagcaggcgctggagacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgcctgcagcgactac

SEQ ID NO: 34310 - DNA, 471 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtctattgctggcgatggccaccacctgctggggggtcaagccgtgggcctggcacagcaccggcaaaggccatccgtcaggatggccttctgcttagtttgatgcctggcagtttatggcggagaactcaagaaagcaatcccacctcactgtttcaaacgctcgatccctcgctctttctcctacctcatctgggacatcatcatagcctcctgcttctactacgtcaccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34311 - DNA, 423 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactctcaggcccacggcttgaccccggagcaggtggtggccatcgccagccacgatggcggcaagcaggcgctggagacgacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34312 - DNA, 308 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtaccctgcgagacactggagacggtctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34313 - DNA, 338 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34314 - DNA, 346 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34315 - DNA, 331 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 34316 - DNA, 314 bp, Artificial
  Mutation in BnaC.FAD2.a introduced by TALE nuclease pair BnFAD2_T03
caggatccatgggtgctggtggaagaatgcaagtgtctcctccctccaagaagtctgaagccgacaccatcaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34317 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcataataactcaagaaagcaatcccaccgcactgtttcaaacgctcgatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34318 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcttaaccggcgtctgggtcatagcccacgagtgcggccaccacgccttcagcgactac

SEQ ID NO: 34319 - DNA, 346 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34320 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttagacctcaagaaagcaaccccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatatcccacgagtgcggccaccacgccatcagcgactac

SEQ ID NO: 34321 - DNA, 395 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactggtggccatcgccagcaatggcggtggcaagcaggcgctggagacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34322 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccactccttcagcgactac

SEQ ID NO: 34323 - DNA, 338 bp, Artificial
  Mutation in BnaC.FAD2.a introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 34324 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagcctgaaaccgacaccctcaagcgcgtaccctgcgagacaccgcccttcactgtagaagtcaagaaagcaatcccaccacactgtttcaaacgctcgatccctcgctctttctcctacctcatctgggacatcatcatagcctcctgcttctactacgtcgccacctcttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34325 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34326 - DNA, 351 bp, Artificial
  Mutation in BnaC.FAD2.a introduced by TALE nuclease pair BnFAD2_T03
caggatccatgggtgcaggtgcaagaatgcaagtgtctcctccctcccagaagtctgaaaccgacaccatcaagcgcgtaccctgcgagacaccgcccttcactgtgagaactcaagaaagcaatcccaccgcactgtttcaaacgctcgatccctcgctctttctcctacctcatcttggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 34327 - DNA, 414 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggagacggtccagcggctgttgccggtgctgtgccaggcccacggtccagcggctgttgccggagacctcaagaaagcaatcccaccgcactgtttcaaacgctcgatccctcgctctttctcctacctcatctgggacatcatcatagcctcctgcttctactacgtcgccaccacttacttccctctccgccctcaccctctctcctacttcgcctggcctctctactgggcctgccaagggtgcgtcctaaccggcgtctgggtcatagcccacgagtgcggccaccacgccttcagcgactac

SEQ ID NO: 34328 - DNA, 338 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagaaagcaatcccaccgcactgcttcaaacgctccagccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34329 - DNA, 417 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgtgggcctggcacagcaccggcaacagccgctggaccgtctccagcgcctgcttgccaccgccattagaactcaagaaagcaatcccaccgcactgtttcaaacgctcgatccctcgctctttctcctacctcatctgggacatcatcatagcctcctgcttctactacgtcgccaccacttacttccctctcctccctcgccctctctcctacttcgcctggcctctctactgggcctgccaagggtgcgtcctaaccggcgtctgggtcatagcccacgagtgcggccaccacgccttcagcgactac

SEQ ID NO: 34330 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 34331 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 34332 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccatgccttcagcgactac

SEQ ID NO: 34333 - DNA, 341 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccgaactcaagaaagcaatctcaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34334 - DNA, 320 bp, Artificial
  Mutation in BnaC.FAD2.a introduced by TALE nuclease pair BnFAD2_T03
cagggatccatgggtgcgggtggaagaatgcaagtgtcttctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaaccggcgtctgggtcatagcccacgagtgcggccaccacgccttcagcgactac

SEQ ID NO: 34335 - DNA, 346 bp, Artificial
  Mutation in BnaC.FAD2.a introduced by TALE nuclease pair BnFAD2_T03
caggatccatgggtgcaggtggaagaatgcaagtttctcctccttcccagaagtctgcaaccgacaccattaagcgcgtaccctgcgagacaccgcccttcactgcctcaggaaagcgatcccaccgcactgtttgatacgctcgctccctcgctctttctcctacctcatctgggacatcatcatctcctcctgcttctactccgttgccaccacttacttccctctcctccctcaccctctctcctccttcgcctggccgctctaccgggcctgccaagggtgcgtcctaaccggcgtctgggtcatagcccaggagtgcggccaccacgccctcagcgactac

SEQ ID NO: 34336 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccaccgcactgtttcaaacgctcgatccctcgctctttctcctacctcatctgggccatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 34337 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgttccctcgctctttctcctacctcatctgggacatcatcatagcctcctgcttctactacgtcgccaccacttacttccctctcctccctcaccctctctcctacttcgcctggcctctctactgggcctgccaaggttgcgtcctaaccggcgtctgggtcatagcccacgagtgcggccaccacgccttcagcgactac

SEQ ID NO: 34338 - DNA, 305 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 34339 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcagaactcaagaaagcaatcccaccgcactgcttcacacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagggcggccaccacgccttcagcgactac

SEQ ID NO: 34340 - DNA, 432 bp, Artificial
  Mutation in BnaC.FAD2.a introduced by TALE nuclease pair BnFAD2_T03
caggatccatgggtgcaggtggaataatgcaagtgtctcctccctccaagaagtctgaaaccgacaacatcaagcgcgtaccctgcgagacaccgcccttcactccagcggctgttgccggtgctgtgccaggcccacggcttgaccccggagcaggtggtggccatcgccagccacgatggcggtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34341 - DNA, 317 bp, Artificial
  Mutation in BnaC.FAD2.a introduced by TALE nuclease pair BnFAD2_T03
caggatccatgggtgcaggtggaagaatgcaagtgtctcctccctacaagaagtctgaaaccgacaccatcaagcgcgtaccctgcgagacaccgcccttcactgtcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34342 - DNA, 349 bp, Artificial
  Mutation in BnaC.FAD2.a introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34343 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34344 - DNA, 346 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 34345 - DNA, 350 bp, Artificial
  Mutation in BnaC.FAD2.a introduced by TALE nuclease pair BnFAD2_T03
caggatccatgggtgcaggtggaagaatgcaagtgactcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34346 - DNA, 352 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgagaactcaagaaagcaatcccaccgcactgtttcaaacgctcgatccctcgctctttctcctaccccatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34347 - DNA, 423 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtcggcgatggccaccacctgctccggggtcaagctgtgggcctggcacagcaccggcaacggccgctggagactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34348 - DNA, 350 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacctcgcccggcctctctaccgggcctgccaagggtgcgtcctaaccggcgtctgggtcatagcccacgagtgcggccaccacgccttcagcgactac

SEQ ID NO: 34349 - DNA, 423 bp, Artificial
  Mutation in BnaC.FAD2.a introduced by TALE nuclease pair BnFAD2_T03
caggatccatgggtgcaggtggaagaatgcaagtgtctcctcccaccaaaaagtctgaaaccgacaccatcaagcgcgtaccctgcgagacaccgcccttcactgtcggcgatggccaccacctgctccggggtcaagccgtgggcctggcacagcaccggcaacagccgctggagactagaactcaagaaagcaatcccaccgcactgtttcaaacgctcgatccctcgctctttctcctacctcatctgggacatcatcatagcctcctgcttctcctacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34350 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 34351 - DNA, 350 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcatggcctctctactgggcctgccaagggtgcgtcctaaccggcgtctgggtcatagcccacgagtgcggccaccacgccttcagcgactac

SEQ ID NO: 34352 - DNA, 347 bp, Artificial
  Mutation in BnaC.FAD2.a introduced by TALE nuclease pair BnFAD2_T03
caggatccatgggtgcaggtggaagaatgcaagtgtcccctctctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcggcctaacgggcctctgggtcatcgcccacgaatgcggccaccacgccttcagcgactac

SEQ ID NO: 34353 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34354 - DNA, 414 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgtgagacaccgcccttcactgtcggtgctgtgccaggcccacggcttgaccccccagcaggtggtggccatcgccagcaataatggcggcaagcaggcggagaactcaagaaagcaatcccaccgcactgtttcaaacgctccatcccacgctccttctcctcttcgacatcatcaccgcctcctcggctcctccctctcccacctccccacagcctacttccctctcccttacctcgcctggcctctctactgggcctgccaaggctgcgtcctaacgggcctctgggtcatagcccacgagtgcggccaccacgccttcagcgactac

SEQ ID NO: 34355 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccctccactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 34356 - DNA, 403 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtctccagcgcctgcttgccgccatcgtggctggcgatggccaccacctgctccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgatac

SEQ ID NO: 34357 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 34358 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtaccctgcgagacaccgcccttcactgagaactcacgaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctcgactgggcctgccaagggtgcgtcctaaccggcgtctgggtcatagcccacgagtgcggccaccacgccttcagcgactac

SEQ ID NO: 34359 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttaccgcgaaagcaatcccaccgcactgtttcaaacgctcgatccctcgctctttctcctacctcatctgggacatcatcatagcctcctgcttctactacgtcgccaccacttacttccctctcctctctcaccctctctcctacttcgcctggcctctctactgggccttccaagggtgcgtcctaaccggcgtctgggtcatagcccacgagtgcggccaccacgccttcagcgactac

SEQ ID NO: 34360 - DNA, 346 bp, Artificial
  Mutation in BnaC.FAD2.a introduced by TALE nuclease pair BnFAD2_T03
caggatccatgggtgcaggtggaagaatgcaagtgtctcttccctccaagaagtctgaaaccgacaccatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34361 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccctttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 34362 - DNA, 349 bp, Artificial
  Mutation in BnaC.FAD2.a introduced by TALE nuclease pair BnFAD2_T03
caggatccatgggtgcaggtgcaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34363 - DNA, 339 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgccctctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcggcctgaccggcggctgggtcatagcccgcgagtgcggccaccacgccttcagcgactac

SEQ ID NO: 34364 - DNA, 319 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgtttcaaacgctcgatccctcgctctttcttctacctcatctgggacatcatcatagcctcctgcttctactacgtcgccaccacttacttccctctcctccctcaccctctctcctacttcgcctggcctctttactgggcctgctaagggtgcgtcctaaccggcgtctgggtcatagcccacgagtgcggccaccacgccttcagcgactac

SEQ ID NO: 34365 - DNA, 317 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcacgtaccctgcgagacaccgcccttcactgtcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34366 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctacttggcctgccaaggctgcgtcctaacgggcctctgggtcatcgcccacgaatgcggccaccacgccttcagcgactac

SEQ ID NO: 34367 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 34368 - DNA, 277 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 34369 - DNA, 338 bp, Artificial
  Mutation in BnaC.FAD2.a introduced by TALE nuclease pair BnFAD2_T03
caggatccatgggtgcaggtggaagaatgcaagtgtctcatccctccaagaagtctgaaaccgacaccatcaagcgcgtaccctccaaaaacacacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34370 - DNA, 345 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttgagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34371 - DNA, 434 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcccagcaggtggtggccatcgccagcaatggcggtggcaagcaggcgctggagacggtccagcggctgttgccggtgctgtgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 34372 - DNA, 344 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34373 - DNA, 334 bp, Artificial
  Mutation in BnaC.FAD2.a introduced by TALE nuclease pair BnFAD2_T03
caggatccatgggtgcaggtgcaagaatgcaagtgtctcctccctccaagaagtctgaaaccgacaccatcaagcgcgtaccctgcgagacaccgcccttcactgaaactcaagaaagcaatcccaccgcactgtttcaaacgctcgatcccacgctccttctcctcttcgacatcatcatctcctcctcggctcctacctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 34374 - DNA, 350 bp, Artificial
  Mutation in BnaC.FAD2.a introduced by TALE nuclease pair BnFAD2_T03
caggatccatgggtgcaggtggaggaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgagtgcggccaccacgccttcagcgactac

SEQ ID NO: 34375 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccaaggctgcgtcctaacgggcctctgggtcatagcccacgagtgcggccaccacgccttcagcgactac

SEQ ID NO: 34376 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtctcaagacagcaatcccaccacactgctccaaactctcgatcccacgctcttcctcctacctcatctgggacatcatcatagcctcctgcttctaccacgccgccacctcttacttccctctccccccccaccctctctcctacttcgcctggcctctctactgggcctgccaagggtgcgtcctaaccggcgtctgggtcatagcccacgagtgcggccaccacgccttcagcgactac

SEQ ID NO: 34377 - DNA, 428 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggtgctgtgccaggcccacggcttgaccccggagcaggtggtggccatcgccagccacgatggcggcaagcaggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaactggcgtctgggtcatagcccacgagtgcggccaccacgccttcagcgactac

SEQ ID NO: 34378 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgaactcaagaaagcaatcccaccgcactgtttcaaacgctcgatccctcgctctttctcctacctcatctgggacatcatcatagcctcctgcttctactacgtcgccaccacttacttccctctcctccctccccctctctcctacttcgcctggcctctctactgggcctgccaagggtgcgtcctaaccggcgtctgggtcatagcccacgagtgcggccaccacgccttcagcgactac

SEQ ID NO: 34379 - DNA, 412 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgtcggaccgtctccagcgcctgcttgccaccatcgtggctggcgatggccaccacctgctccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34380 - DNA, 397 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttggcggcaacagccgctggaccgtctccagcgcctgcttgccggtggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 34381 - DNA, 342 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtaccctgcaagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34382 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcccctggcctctctactgggcctgccaagggtgcgtcctaaccggcgtctgggtcatagcccacgagtgcggccaccacgccttcagcgactac

SEQ ID NO: 34383 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgcccccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 34384 - DNA, 350 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaagggtgcgtcctaaccggcctctgggtcacagcccacgagtgcggccaccacgccttcagcgactac

SEQ ID NO: 34385 - DNA, 334 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcccttacctcgcctgacccctctactgggcctgccaaggctgcgtcctaacgggcctctgggtcatagcccacgagtgcggccaccacgccttcagcgactac

SEQ ID NO: 34386 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaggggtgcgtcctaaccggcctctgggtcatcgcccacgaatgcggccaccacgccttcagcgactac

SEQ ID NO: 34387 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggtctgccaagggtgcgtcctaaccggcgtctgggtcatagcccacgagtgcggccaccacgccttcagcgactac

SEQ ID NO: 34388 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 34389 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccatgggtgcgtcctaaccggcgtctgggtcatagcccacgagtgcggccaccacgccttcagcgactac

SEQ ID NO: 34390 - DNA, 344 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaaacgcgtcccctgcgagacaccaccattcaccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagcgtgcgtcctaaccggggtctgggtcatagcccgcgagtgcggccaccacgccttcagcgactac

SEQ ID NO: 34391 - DNA, 434 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcccagcaggtggtggccatcgccagcaatggcggtggcaagcaggcgctggagacggtccagcggctgttgccggtgctgtgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34392 - DNA, 336 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 34393 - DNA, 345 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34394 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactgtttcaaacgctcgatccctcgctctttcttctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 34395 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctaccaagggtgcgtcctaaccggcgtctgggtcatagcccacgagtgcggccaccacgccttcagcgactac

SEQ ID NO: 34396 - DNA, 359 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttccaacgctcgatccctcgctctttctcctacctcatctgggacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 34397 - DNA, 349 bp, Artificial
  Mutation in BnaC.FAD2.a introduced by TALE nuclease pair BnFAD2_T03
caggatccatgggtgcaggtggaagaatgcaagtgtctcctccctccaaaaagtctgaagccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34398 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccccgcgagacaccaccattcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcccctggcctctctactgggcctgccaaggctgcgtcctaacgggcctctgggtcatagcccacgagtgcggccaccacgccttcagcgactac

SEQ ID NO: 34399 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctccatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 34400 - DNA, 351 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtccgaaccggcgtctgggtcatagcccacgagtgcggccaccacgccttcagcgactac

SEQ ID NO: 34401 - DNA, 343 bp, Artificial
  Mutation in BnaC.FAD2.a introduced by TALE nuclease pair BnFAD2_T03
caggatccatgggtgcaggtggaagaatgcaagtctctcctccctccaagaagcctgaaaccgacaccctcaagcgcgtaccctgcgagacaccgcccttcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34402 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34403 - DNA, 350 bp, Artificial
  Mutation in BnaC.FAD2.a introduced by TALE nuclease pair BnFAD2_T03
caggatccatgggtgcaggtggaagaatgcaagtgactcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccactccttcagcgactac

SEQ ID NO: 34404 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggacccaacaccctcaaacgcgtcccctgcgagacaccaccattcactgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34405 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgtgacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34406 - DNA, 376 bp, Artificial
  Mutation in BnaC.FAD2.a introduced by TALE nuclease pair BnFAD2_T03
caggatccatgggtgcaggtggaagaatgcaagtctctcctcactccagctcccccgaaaccaaaaccctcaaacgcgtcccctgcgaggcaccacccttcactctgctgcgtaacatcgttgctgctccagagacctcaagaaagcaatcccaccgcactgtttcaaacgctcgatccctcgctctttctcctacctcatctgggacatcatcatagcctcctgcttctactacgtcgccaccacttacttccctctcctccctcaccccctctcctacttcgcctggcctctctactgggcctgccaagggtgcgtcctaaccggcgtcttggtcatagcccacgagtgcggccaccacgccttcagcgactac

SEQ ID NO: 34407 - DNA, 351 bp, Artificial
  Mutation in BnaC.FAD2.a introduced by TALE nuclease pair BnFAD2_T03
caggatccatgggtgcaggtggaagaatgcaagtgtctcctccctccaaaaagtccgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34408 - DNA, 283 bp, Artificial
  Mutation in BnaC.FAD2.a introduced by TALE nuclease pair BnFAD2_T03
caggatccatgggtgcaggtggaagaatgcaagttcctcctccctcaagaaagcaatcccaccacactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 34409 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaaacaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34410 - DNA, 346 bp, Artificial
  Mutation in BnaC.FAD2.a introduced by TALE nuclease pair BnFAD2_T03
caggatccattgcaggtggaagaatgcaagtgtctcctccctccaagaagtctgaaaccgacaccatcaagcgcgtaccctgcgagacaccgcccttcactgggaactcaagaaagcaatcccaccgcactgtttcaaacgctcgatccctcgctctttctcctacctcatctgggacatcatcatagcctcctgcttctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 34411 - DNA, 368 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacggtggtttgtttgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggcatagcccacgagtgcggccaccacgccttcagcgactac

SEQ ID NO: 34412 - DNA, 381 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgtgagacaccgcccttcactttcgaggcatttctgtcctggctggtctagaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34413 - DNA, 333 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacacctcaagaaagcaatcccaccgcactgtttcaaacgctcgatccctcgctctttctcctacctcatctgggacatcatcatagcctcctgcttctactacgtcgccacctcttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34414 - DNA, 327 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttccccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaaccggcgtctgggtcatagcccacgagtgcggccaccacgccttcagcgactac

SEQ ID NO: 34415 - DNA, 396 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctctgagcctttcgttttatctgttgtttgtcggtgaacgctctcctgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34416 - DNA, 356 bp, Artificial
  Mutation in BnaC.FAD2.a introduced by TALE nuclease pair BnFAD2_T03
caggatccatgggtgcaggtggaagaatgcaagtctctcctccctccaagacgtctgaaaccgacaccatcaagcgcgtaccctgcgagacaccgcccttcactgtcggcggagaactcaagaaagcaatcccaccgaactgtttcaaacgctcgatccctcgctctttctcctacctcatctggcacatcatcatagcctcctgcctctactacgtcgccaccacttacttccctctcttccctcaccctctctcctacttcgcctggcctctctactgggcctgccaagggtgcgtcctaacgggcctctgggtcatcgcccacgaatgcggccaccacgccttcagcgactac

SEQ ID NO: 34417 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34418 - DNA, 349 bp, Artificial
  Mutation in BnaC.FAD2.a introduced by TALE nuclease pair BnFAD2_T03
caggatccatgggtgcaggtggaagaatgaagtctctcctccctccagctcccccggaaccaacaccatcaaacgcgtcccctgcgagacaccacccttcactctcggcctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34419 - DNA, 340 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34420 - DNA, 338 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaaaacaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 34421 - DNA, 436 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacggtccagcggctgttgccggtgctgtgccaggcccacggcttgaccccccagcaggtggtggccatcgccagcaatggcggtggcacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34422 - DNA, 342 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaccctgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccggccaagggtgcgtcctaacgggcctctgggtcatagcccacgagtgcggccaccacgccttcagcgactac

SEQ ID NO: 34423 - DNA, 300 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34424 - DNA, 338 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 34425 - DNA, 287 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacacagcccttctcctacctcatctgggacatcatcatagcctcctgcttctactacgacgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34426 - DNA, 346 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34427 - DNA, 349 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34428 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 34429 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34430 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgttccctcgctctttctcctacctcatctgggacatcatcatagcctcctgcttctactacgtcgccaccacttacttccctctcctccctcaccctctctcctactgcgccaggcctctctactgggcctgccaagggtgcgtcctaacgggcctctgggtcatagcccacgagtgcggccaccacgccttcagcgactac

SEQ ID NO: 34431 - DNA, 351 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccacccttcactcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 34432 - DNA, 287 bp, Artificial
  Mutation in BnaC.FAD2.a introduced by TALE nuclease pair BnFAD2_T03
caggatccatgggtgcaggtggaagaatgcaagtgtctcctccctccaacaagcctgaaaccgacaccctcaagcgcgtcccctgcgagacaccgcccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34433 - DNA, 354 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34434 - DNA, 336 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 34435 - DNA, 354 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctgacgggcctctgggtcatagcccacgagtgcggccaccacgccttcagcgactac

SEQ ID NO: 34436 - DNA, 308 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagaaagcaatcccaccgccctgtttcaacacctccatcccacgctctttctcctacctcctctgcgacatcatcatatcctcctgcttctactacgtcgccaccacttacttcactctcctccctcaccctctctcctacttcgcctggcctctctactgggcctgccaagggtgcgtcctaaccggcgtctgggtcatagcccacgagtgcggccaccacgccttcagcgactac

SEQ ID NO: 34437 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcttcgcctggcctctctactgggcctgccaagggtgcgtcctaaccggcgtctgggtcatagcccacgagtgcggccaccacgccttcagcgactac

SEQ ID NO: 34438 - DNA, 411 bp, Artificial
  Mutation in BnaC.FAD2.a introduced by TALE nuclease pair BnFAD2_T03
caggatccatgggtgaggtggaagaatgcaagtgtctcctccctccaagaagtctgaaaccgacaccatcaagcgcgtaccctgcgagacaccgcccttcactgacggatggcctttttgcgtttctacaaactcttcctggctagcggtacgcgtattaattgcggagaactcaagaaagcaatcccaccgcactgtttcaaacgctcgatccctcgctctttctcctacctcatctgggacatcatcatagcctcctgctgctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34439 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcggcctaaccggcgtctgggtcatagcccacgagtgcggccaccacgccttcagcgactac

SEQ ID NO: 34440 - DNA, 442 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttcgccagccacgatggcggcaagcaggcgctggagacggtccagcggctgttgccggtgctgtgccaggcccacggcttgaccccccagcagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34441 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacacaatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccccaccctctctcctacttcgcctggcctctctactgggcctgccaagggtgcgtcctaaccggcgtctgggtcatagcccacgagtgcggccaccacgccttcagcgactac

SEQ ID NO: 34442 - DNA, 436 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacggtccagcggctgttgccggtgctgtgccaggcccacggcttgaccccacagcaggtggtggccatcgccagcaatggcggtggcacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctagccggcgtctgggtcatagcccacgagggcggccaccacgccttcagcgactac

SEQ ID NO: 34443 - DNA, 412 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgactgggcctttcgttttatctgttgtttgtcggtgaacgctctcctgtgtaggacaaatccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34444 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccactgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 34445 - DNA, 468 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggattgcaaaacgtggcggcgtgaccgcagtggaggcagtgcctgcatggcgcaatgcactgacgggtgccccgctcaacttgaccccccagcagggggtggccatcgccagcacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34446 - DNA, 434 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtcccagcaggtggtggccatcgccagcaatggcggtggcaagcaggcgctggagacggtccagcggctgttgccggtgctgtgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34447 - DNA, 342 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccacctcgccttcagcgactac

SEQ ID NO: 34448 - DNA, 317 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34449 - DNA, 391 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacggtccagcggctgttgccggtgctgtgccaggcccacggagaactcaagaaagcaatcccaccgcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34450 - DNA, 343 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaactcaagaaagcaatcccaccgcactgtttcaaacgctcgatccctcgctctttctcctacctcatctgggacatcatcatagcctcctgcttctactacgtcaccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34451 - DNA, 341 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaagaaagcaatcccaccgcactgtttcaaacgctcgatccctcgctctttctcctacctcatctgggacatcatcatagcctcctgcttctactacgtcgccaccacttacttcctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34452 - DNA, 317 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 34453 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34454 - DNA, 397 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttggcgacaacagccgctggaccgtctccagcgcctgcttgccggtggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 34455 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 34456 - DNA, 350 bp, Artificial
  Mutation in BnaC.FAD2.a introduced by TALE nuclease pair BnFAD2_T03
caggatccatgggtgcaggtggaagaatgcaagtctctcctccctcccgctcccccgaaaccaaaaccctcaaacgcgtcccctgcgagacaccacccttcactcgagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34457 - DNA, 434 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccctcaaacgcgtcccctgcgagacaccaccattcactctcggtgttgtgccaggcccacggcttgaccccggagcaggtggtggccatcgccagccacgatggcggcaacagccgctggacccagacctcaagaaagcaatcccacctcactgcttcaaacgctccatcccacgctccttcacctacctcatctgggacatcatcatagcctcctgcttcgactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34458 - DNA, 327 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttccccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 34459 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaatggtgcgtcctaaccggcgtctgggtcatagcccacgagtgcggccaccacgccttcagcgactac

SEQ ID NO: 34460 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 34461 - DNA, 329 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcatcccaccgcactgtttcaaacgctcgatccctcgctctttctcctacctcatctgggacatcatcatagcctcctgcttctactacgtcgccaccacttacttccctctcctccctcaccctctctcctacctcgcctggcccctctactgggcctgccaaggctgcgtcctaacgggcctctgggtcatcgcccacgaatgcggccaccacgccttcagcgactac

SEQ ID NO: 34462 - DNA, 350 bp, Artificial
  Mutation in BnaC.FAD2.a introduced by TALE nuclease pair BnFAD2_T03
caggatcatgggtgcaggtggaagaatgcaagtgtctcctccctccaagaagtctgaaaccgacaccatcaagcgcgtaccctgcgagacaccgcccttcactgcaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34463 - DNA, 431 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggctgttgccggtgctgtgccaggcccacggcttgaccccggagcaggtggtggccatcgccagccacgatggcggcaagagacctcaagaaagcaatcccacctcactgcttcaaacgctcgatccctcgctctttctcctacctcatctgggacatcatcatatcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34464 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccaacaccctcaagcgcgtaccctgcgagacaccgccattcactcaagaaagcaatcccaccgcactgtttcaaacgcgcgatacctcgctctttctcctacctcatctgggacctcatcatagcctactgcttctactacgtccccacctcttacttcactctcctctctcaccctctctcctacttcgcctggccgctctactgggcctgccaagggtgcgtcctaaccggcgtctgggtcatagcccacgagtgcggccaccacgccttcagcgactac

SEQ ID NO: 34465 - DNA, 345 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 34466 - DNA, 381 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgctagacaccgcccttcactgtcgaggcatttctgtcctggctggtctagaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34467 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccggcctctctactgggcctgccaagggtgcgtcctaaccggcgtctgggtcatagcccacgagtgcggccaccacgccttcagcgactac

SEQ ID NO: 34468 - DNA, 423 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcgatggccaccacctgctccggggtcaagccgtgggcctggcacagcaccggcaacaggcgctggagactagaactcaagaaagcaatcccaccgcactgtttcaaacgctcgatccctcgctctttctcctacctcatccgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34469 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcataccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34470 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 34471 - DNA, 346 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgtagagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcctctgggtcatcgcccacgaatgcggccaccacgccttcagcgactac

SEQ ID NO: 34472 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 34473 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatccaaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctggtcatagcccacgagtgcggccaccacgccttcagcgactac

SEQ ID NO: 34474 - DNA, 347 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34475 - DNA, 417 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttgtccggccacttcaagggcaactacaaggcccagctgaccaggctgaaccacatcaccaactgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34476 - DNA, 391 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacggtccagcggctgttgccggtgctgtgccaggcccacggagaactcaagaaagcaatcccaccgcactgtttcaaacgctcgatccctcgctctttctcctacctcatctgggacatcatcatagcctcctgcttctactacgtcgccaccacttacttccctctcctccatcaccctctctcctacttcgcctggcctctctactgggcctgccaagggtgcgtcctaacgggcctctgggtcatcgcccacgaatgcggccaccacgccttcagcgactac

SEQ ID NO: 34477 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34478 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcacgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34479 - DNA, 338 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaaaacaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34480 - DNA, 372 bp, Artificial
  Mutation in BnaC.FAD2.a introduced by TALE nuclease pair BnFAD2_T03
cagggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctctaccacctctccccagcctacttccctctcccttacctcgcctgacccctctactgggcctgccaaggctgcgtcctaacgggcctctgggtcatagcccacgagtgcggccaccacgccttcagcgactac

SEQ ID NO: 34481 - DNA, 415 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgcccacggcttgaccccggagcaggtggtggccatcgccagccacgatggcggcaacagccgctggaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34482 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagggcggccaccacgccttcagcgactac

SEQ ID NO: 34483 - DNA, 326 bp, Artificial
  Mutation in BnaC.FAD2.a introduced by TALE nuclease pair BnFAD2_T03
caggtccatgggtgcaggtggaagaatgccagtgtctcctccctccaagaagtctgaaaccgacaccatcaagcgcgtaccctgcgagacatcaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34484 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccacctcttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34485 - DNA, 411 bp, Artificial
  Mutation in BnaC.FAD2.a introduced by TALE nuclease pair BnFAD2_T03
caggatccatgggtgcaggtggaagaatgcaagtgtctcctccatccaagaagtctgaaaccgacaccatcaagcgcgtaccctgcgagacaccgcctttcactgtgtacgtgccccaagagtacatcgagctgatcgagatcgcccggaacagcacccaggaccggagaactcaagaaagcaatcccaccgcactgtttcaaacgctcgatccctcgctctttctcctacctcatctgggacatcatcatagcctcctgcttctcctacgtcgccaccacttacttccctctcctccctccccctctctcctacttcgcctggcctctctactgggcctgccaagggtgcgtcctaaccggcgtctggttcatagcccacgagtgcggccaccacgccttcagcgactac

SEQ ID NO: 34486 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagggcggccaccacgccttcagcgactac

SEQ ID NO: 34487 - DNA, 433 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcaacagccgctggaccgtctccagcgcctgcttgccaccattattgctggcgatggccaccacctgccatcccacgttccagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34488 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccaagggtgcgtcctaaccggcgtctgggtcatagcccacgagtgcggccaccacgccttcagcgactac

SEQ ID NO: 34489 - DNA, 344 bp, Artificial
  Mutation in BnaC.FAD2.a introduced by TALE nuclease pair BnFAD2_T03
caggatccatgggtgcaggtgcaagaatgcaagtctctcctcactcccgctcccccgaaaccaaaaccctcaaacgcgtcccctgcgagccaccacccttcactctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctgaccggcgtctgggtcatagcccgcgagtgcggccaccacgccttcagcgactac

SEQ ID NO: 34490 - DNA, 343 bp, Artificial
  Mutation in BnaC.FAD2.a introduced by TALE nuclease pair BnFAD2_T03
caggatccatgggtgcaggtggaagaatgcaagtatctactccctccagctcccccggaaccaacaccctcaaacgcgtcccctgcgagacaccaccatagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34491 - DNA, 345 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34492 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgtgtcatagcccacgagtgcggccaccacgccttcagcgactac

SEQ ID NO: 34493 - DNA, 335 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 34494 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttaccgcgaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34495 - DNA, 385 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgaggcttgttgtgaagggattccaacaaaaagtaggcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 34496 - DNA, 341 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34497 - DNA, 346 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgtttcaaacgctcgatccctcgctctttctcctatctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34498 - DNA, 379 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggtcatagcattggatcggatcccgggcccgagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 34499 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcactac

SEQ ID NO: 34500 - DNA, 339 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccctctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34501 - DNA, 342 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34502 - DNA, 347 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34503 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34504 - DNA, 401 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaagcgcgtaccctgcgagacaccgcccttcacggtccagcggctgttgccgccatcgtggctggcgatggccaccacctgctccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34505 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcggcctaaccggcgtctgggtcatagcccacgagtgcggccaccacgccttcagcgactac

SEQ ID NO: 34506 - DNA, 418 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcggatttgtcctactcaggagagcgttcaccgacaaacaacagataaaacgaaaggctcagtctttgacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34507 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcgtccaccacgccttcagcgactac

SEQ ID NO: 34508 - DNA, 305 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactggtcctgccaagggtgcgtcctaaccggcgtctgggtcatagcccacgagtgcggccaccacgccttcagcgactac

SEQ ID NO: 34509 - DNA, 448 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccccagcaggtggtgaccatcgccagcaataatggtggcaagccagcggctgttgccggtgctgtgccaggcccacggcttgaccccccagcaggtggtggccatcgccagcaaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34510 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34511 - DNA, 341 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttaactcaagaaagcaaccccaccgcactgtttcaaacgctcgatccctcgctctttcccctacctcatctggcacatcatcataccctcctgcttctactacgtccccaccacttacttccctctcctccctcaccctccctcctccttcgcctgccctctctactggcccggccaaggtggcgtcctaaccggcgcctggttcttagcccacgagtgcgccccccacgccttcagcactac

SEQ ID NO: 34512 - DNA, 345 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacttggcctgccaagggtgcgtcctaaccggcgtctgggtcatagcccacgagtgcggccaccacgccttcagcgactac

SEQ ID NO: 34513 - DNA, 349 bp, Artificial
  Mutation in BnaC.FAD2.a introduced by TALE nuclease pair BnFAD2_T03
caggatcccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34514 - DNA, 410 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggttcagcctggtcagctgggccttgtagttgcccttgaagtggccggacacgaacaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgtgtccaccacgccttcagcgactac

SEQ ID NO: 34515 - DNA, 351 bp, Artificial
  Mutation in BnaC.FAD2.a introduced by TALE nuclease pair BnFAD2_T03
caggatccattggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34516 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34517 - DNA, 300 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 34518 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34519 - DNA, 413 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcggccatcgccagcaatggcggtggcaagcaggcgctggagacggtccagcggctgttgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcttggcctctctactgggtctgccaagggtgcgtcctaacgggcctctgggtcatagcccacgagtgcggccaccacgccttcagcgactac

SEQ ID NO: 34520 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34521 - DNA, 315 bp, Artificial
  Mutation in BnaC.FAD2.a introduced by TALE nuclease pair BnFAD2_T03
caggatccatgggtgcaggtggaagaatgcaagtctctcctccctcccgtccccccggaaacaacaccctcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34522 - DNA, 369 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtacggtggtttgtttgccggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 34523 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34524 - DNA, 446 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcggcctggagacggtccagcggctgttgccggtgctgtgccaggcccacggcttgaccccggagcaggtggtggccatcgccagccacgatggcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34525 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctacgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34526 - DNA, 368 bp, Artificial
  Mutation in BnaC.FAD2.a introduced by TALE nuclease pair BnFAD2_T03
caggatccatgggtgcatgtggaagaatgcaagtgtctcctccctccaagaagtctgaaaccgacaccatcaagcgcgtaccctgcgagacaccgcccttcactgtagcaatggcggtggctggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactcc

SEQ ID NO: 34527 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccatttcggagacctcaagaaagcaatcccaccgcactgtttcaaacgctcgatccctcgctctttcttctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34528 - DNA, 316 bp, Artificial
  Mutation in BnaC.FAD2.a introduced by TALE nuclease pair BnFAD2_T03
caggatccatgggtgcaggtggaagaatgcaagtctctcctccctccaagaaccctgaaaccaacaccatcaagaactcaagaaaccaatcccaccgcactgtttcaaacgccctatccctcgctctttctcctacctcatctggaccatcatcctagcctcctgcctctactaccccgccccctcttacttccctctcctccctctccctctctcctacttcgcctgtcctctctactgggcctgccaagggtgcgtcctaaccggcgtctgggtcatagcccacgagtgcggccaccacgccttcagcgactac

SEQ ID NO: 34529 - DNA, 433 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcaacagccgctggaccgtctccagcgcctgcttgccaccattattgctggcgatggccaccacctgccatcccacgttccagacctcaagaaagcaatcccaccgcactgtttcaaacgctcgatccctcgctctttctcctacctcatcggggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34530 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccaccgcactgtttcaaacgctcgatccctcgctctttctcctacctcctctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34531 - DNA, 341 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 34532 - DNA, 342 bp, Artificial
  Mutation in BnaC.FAD2.a introduced by TALE nuclease pair BnFAD2_T03
caggatccatgggtgcaggtggaagaatgcaagtgtctcctcactccaagaagtctgaaaccgacaccatcaagcgcgtaccctgcgagacaccgcccttcactgtagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagctcacgagtgcggccaccacgccttcagcgactac

SEQ ID NO: 34533 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgggagaactcaagaaagcaatccccccgcactgtttcaaacgctcgatccctcgctctttctcctccctcatctgggacatcatcatagcctcctgcttctcttacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 34534 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctaccgggcctgccaagggtgcgtcctaaccggcgtctgggtcatagcccacgagtgcggccaccacgccttcagcgactac

SEQ ID NO: 34535 - DNA, 346 bp, Artificial
  Mutation in BnaC.FAD2.a introduced by TALE nuclease pair BnFAD2_T03
gcaggatccatgggtgcaggtggaagaatgcaagtgtctcctccctccaaaaagtctgaaaccgacaccatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34536 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 34537 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaagaactcaagaaagcaatcccaccgcactgttccaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34538 - DNA, 384 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggtcagggtgccggccttgatcatctcgccgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgcctggcctctctactgggcctgccaagggtgcgtcctaaccggcgtctgggtcatagcccacgagtgcgtccaccacgccttagcgactac

SEQ ID NO: 34539 - DNA, 341 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34540 - DNA, 339 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34541 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccactagtgcggccaccacgccttcagcgactac

SEQ ID NO: 34542 - DNA, 335 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagtgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcccttacctcgcctgacccctctactgggcctgccatggctgcgtcctaacgggcctctgggtcatagcccacgagtgcggccaccacgccttcagcgactac

SEQ ID NO: 34543 - DNA, 349 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtacccttcgagacaccgcccttcactgtagactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34544 - DNA, 351 bp, Artificial
  Mutation in BnaC.FAD2.a introduced by TALE nuclease pair BnFAD2_T03
caggatccatgggtgcaggtggaagaattcaagtgtctcctccctccaagaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34545 - DNA, 314 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 34546 - DNA, 347 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 34547 - DNA, 338 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactaaaacaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34548 - DNA, 316 bp, Artificial
  Mutation in BnaC.FAD2.a introduced by TALE nuclease pair BnFAD2_T03
caggatccatgggtgcagggagaagaatgcaagtgtttcttccctccaagaagtctgaaaccgacaccatcaagaactcaagaaagcaatcacaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgtgcctgccaagagtgcttcctaacgggcctcttggtcatcgcccacgaatgcggccaccacgccttcaccgactac

SEQ ID NO: 34549 - DNA, 349 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgtgtcctaaccggcgtctgggtcatagcccacgagtgcggccaccacgccttcagcgactac

SEQ ID NO: 34550 - DNA, 349 bp, Artificial
  Mutation in BnaC.FAD2.a introduced by TALE nuclease pair BnFAD2_T03
caggatccatgggttcaggtggaagaatgcaagtgtctcctccctccaagaagtctgaaaccgacaccatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgctgccaccacgccttcagcgactac

SEQ ID NO: 34551 - DNA, 277 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 34552 - DNA, 412 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgacggatggcctttttgcgtttctacaaactcttcctggctagcggcccgcgtattaattgcggcgaactcaagaaagccatcccaccgcactgtttcaaacgctcgatccctcgctctttctcctacctcatctgggccctcatcatagcctcctgcttctactccgtcgccaccccttacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 34553 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgggacaccgcccttcactgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34554 - DNA, 332 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgagcccccgatttagagcttgacggggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgatac

SEQ ID NO: 34555 - DNA, 402 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggggtcaagccgtgggcctggcacagcaccggcaagcaggcgctggagacgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcccgccaagggtgcgtcctaaccggcgtctgggtcatagcccacgagtgcggccaccacgccttcagcgactac

SEQ ID NO: 34556 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttcgcctggcctctctactgggcctgccaagggtgcgtcctagccggcgtctgggtcgtagcccacgagtgcggccaccacgccttcagcgactac

SEQ ID NO: 34557 - DNA, 433 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcggtggcaagcaggcgctggagacggtccagcggctgttgccggtgctgtgccaggcccacggcttgaccccccagcaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34558 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactggtcctgccaaggctgcgtcctaacgggcctctgggtcatagcccacgagtgcgtccaccacgccttcagcgactac

SEQ ID NO: 34559 - DNA, 329 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaaacgcgtcccctgttatcgagacctcaagaaagcaatcccacctcactgcttcaaacgctccatcccacgctccttctcctcttcgacatcatcatagcctactgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34560 - DNA, 347 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcaagaaagcaatcccacctcactgcttcaaacgctcgatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34561 - DNA, 436 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtaccccggagcaggtggtggccatcgccagcaatattggtggcaagcaggcgctggagacggtgcaggtggtgtggtcaagccgtggagaactcaagaaagcaatgccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34562 - DNA, 347 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 34563 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagcctgaaaccgaaaccatcaaacgcgtaccctgcgagacaccgcccttcactgtagaactcaagaaagcaatcccaccgcactgcttcaaacgctccacccctcgctctttctcctacctcatctgcgacatcatcatagcctcctgcttctactacgtcgccaccacctacttccctctcctccctcaccctctctcctacctcgcctggcctctctactgggcctgccaagggtgcgtcctaaccggcgtctgggtcatagcccacgagtgcggccaccacgccttcagcgactac

SEQ ID NO: 34564 - DNA, 413 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggccatcgccagcaatggcggtggcaagcaggcgctggagacggtccagcggctgttgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcgaccaccacgccttcagcgactac

SEQ ID NO: 34565 - DNA, 356 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagtgtgcgtcctaaccggcgtctgggtcatagcccacgagtgcggccaccacgccttcagcgactac

SEQ ID NO: 34566 - DNA, 335 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatctcctcctcggctcctccctataccacctctccacagcctacttccctctcccttacctcgcctgacccctctactgggcctgcaaaggctgcgtcctaacgggcctctgggtcatagcccacgagtgcggccaccacgccttcagcgactac

SEQ ID NO: 34567 - DNA, 350 bp, Artificial
  Mutation in BnaC.FAD2.a introduced by TALE nuclease pair BnFAD2_T03
caggatccatgtgtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34568 - DNA, 352 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactacc

SEQ ID NO: 34569 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34570 - DNA, 406 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggctggcgatggccaccacctgctggggggtcaagccgtgggcctggcacagcaccggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 34571 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacatcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34572 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34573 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34574 - DNA, 408 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtcggacttcgctgctacccaaggttgccgggtgacgcacaccgtggaaacggatgaaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34575 - DNA, 344 bp, Artificial
  Mutation in BnaC.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgctgccaccacgccttcagcgactac

SEQ ID NO: 34576 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 34577 - DNA, 338 bp, Artificial
  Mutation in BnaC.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 34578 - DNA, 370 bp, Artificial
  Mutation in BnaC.FAD2.a introduced by TALE nuclease pair BnFAD2_T03
caggatccatgggtgcaggtggaagaatgcaagtctctcctccctccagctcccccggaaccgacaccatcaagcgcgtaccctgcgagacaccgcccttcaatggcaagcaggcgctggagacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34579 - DNA, 346 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 34580 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctacctcatctgggacatcatcatagcctcctgcttctactacgtcgccacctcttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34581 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactaagtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34582 - DNA, 350 bp, Artificial
  Mutation in BnaC.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34583 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactctcaagaaagcaatcccaccgcactgtttcaaacgctcgaaccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34584 - DNA, 432 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcccagcaggtggtggccatcgccagcaatggcggtggcaagcaggcgctggagacggtccagcggctgttgccggtgctgtgccagaactcaagaaagcaatcccaccgcactgtttcaaacgctcgatccctcgctctctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34585 - DNA, 350 bp, Artificial
  Mutation in BnaC.FAD2.a introduced by TALE nuclease pair BnFAD2_T03
caggatccatgagtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggccatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 34586 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 34587 - DNA, 342 bp, Artificial
  Mutation in BnaC.FAD2.a introduced by TALE nuclease pair BnFAD2_T03
caggatccatgggtgcaggtgaaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34588 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcacttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34589 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34590 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 34591 - DNA, 345 bp, Artificial
  Mutation in BnaC.FAD2.a introduced by TALE nuclease pair BnFAD2_T03
caggatccatgggtgcaggtggaagaatgcaagtgcatcctccctccaagaagtctgaaaccgacaccatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34592 - DNA, 333 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34593 - DNA, 277 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccgtcagcgactac

SEQ ID NO: 34594 - DNA, 368 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagcaatggcgggggctggagaactcaagaaagcaatcccaccgcactgtttcaaacgctcgatccctcgctctttctcctacctcatctgggacatcatcatagcctcctgcttctactacgtcgccaccacttacttccctctcctccctcaccatctctcctacttcgcctggcctctctactgggcctgccaagggtgcgtcctaaccggcgtctgggtcatagcccacgagtgcggccaccacgccttcagcgactac

SEQ ID NO: 34595 - DNA, 409 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtaccctgcgagacaccgcccttcactgtcggccagttaccttcggaaaaagagttggtagctcttgatccggcaaacaaaccaccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34596 - DNA, 413 bp, Artificial
  Mutation in BnaC.FAD2.a introduced by TALE nuclease pair BnFAD2_T03
caggatccatgggtgcaggtggaagaatgcaagtgtctcctccctccaagaagtccgaaaccgacaccatcaagcgcgtaccctgcgagacaccgcccttcactgtcgggatgggatccgatccaatgaagacaatcgacatagtgactggatatgttgtgttttacagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34597 - DNA, 350 bp, Artificial
  Mutation in BnaC.FAD2.a introduced by TALE nuclease pair BnFAD2_T03
caggatccatgggtgcaggtggaagaatgcaagtgaatcctccctccaagaagtctgaaaccgacaccatcaagcgagtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgggcctctctactgggcctgccaagggtgcgtcctaaccggcgtcggggtcatagcccacgagtgcggccaccacgccttcagcaactac

SEQ ID NO: 34598 - DNA, 336 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttagaactcaagaaagcaatcccaccgcactgtttcaaacgctcgatccctcgctctttctcctacctcctcttcgccatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 34599 - DNA, 317 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatacgcaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 34600 - DNA, 436 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaccccggagcaggtggtggccatcgccagcaatattggtggcaagcaggcgctggagacggtgcaggtggtggggtcaagccgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34601 - DNA, 308 bp, Artificial
  Mutation in BnaC.FAD2.a introduced by TALE nuclease pair BnFAD2_T03
caggatccatgggtgcaggtgcaagaatgcaagtgtctcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggcctccacgccttcagcgactac

SEQ ID NO: 34602 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctttcctacttcgcctgacccctctactgggcctgccaaggctgcgtcctaacgggcctctgggtcatagcccacgagtgcggccaccacgccttcagcgactac

SEQ ID NO: 34603 - DNA, 333 bp, Artificial
  Mutation in BnaC.FAD2.a introduced by TALE nuclease pair BnFAD2_T03
caggatccatgggtgcaggtggaagaatgcaagtctctcctccctccagctcccccggaacaaacaccctcaaacgcgtcccctgcgagacaccacaagaaagcaatcccaccgcactgtttcaaacgctcgatccctcgctctttatcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 34604 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 34605 - DNA, 370 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgagtaccctgcgagacaccgcccttcaatggcaagcaggcgctggagacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34606 - DNA, 352 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34607 - DNA, 413 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggccatcgccagcaatggcggtggcaagcaggcgctggagacggtccagcggctgttgccggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctgacccctctactgggcctgccaaggctgcgtcctaacgggcctctgggtcatcgcccacgaatgcggccaccacgccttcagcgactac

SEQ ID NO: 34608 - DNA, 436 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacggtccagcggctgttgccggtgctgtgccaggcccacggcttgaccccccagcaggtggtggccatcgccagcaatggcggtggcacggagaactcaagaaagcaatcccaccgcactgtttcaaacgctcgatccctcgctctttctcctccctcacctgggacatcatcatagcctcctgcttctactacgtcgccaccacttccttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 34609 - DNA, 421 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcacgtaccctgcgagacaccgcccttcactgaccgtctccagcgcctgcttgccggtgctgtgccgccatcgtggctggcgatggccaccacctgctccggggagaactcaagaaagcaatcccaccgcactgtttcaaacgctcgatccctcgctctttctcctacctcatctgggacatcatcatagcctcctgcttctaatacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34610 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctcggggtcatcgcccacgaatgcggccaccacgccttcagcgactac

SEQ ID NO: 34611 - DNA, 334 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcccttacctcgcctgacccctctactgggcctgccaaggctgcgtcctaacgggcctctgggtcatagcccacgagtgcggccaccacgccttcagcgactac

SEQ ID NO: 34612 - DNA, 277 bp, Artificial
  Mutation in BnaC.FAD2.a introduced by TALE nuclease pair BnFAD2_T03
caggatccatgggtgcaggtggaagaatgcaagtctctcctccctccagctcccccggaaccgacaccatcaagcgcgtaccctgcgagacaccgcccttcactgagacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34613 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaaacgcgtaccctgcgagacaccgcccttcactataactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttcgcctggcctctctactgggcctgccaagggtgcgtcctaaccggcgtctgggtcatagcccacgagtgcggccaccacgccttcagcgactac

SEQ ID NO: 34614 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 34615 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgcgcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34616 - DNA, 369 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctgctgcgtaacatcgttgctgctccagagacctcaagaaagcaatcccacctcactgcttcaaacgctccatcccacgctccttctcctcttcgacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34617 - DNA, 325 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtatagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgagtgcggccaccacgccttcagcgactac

SEQ ID NO: 34618 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccactagtgcggccaccacgccttcagcgactac

SEQ ID NO: 34619 - DNA, 295 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcgctctttctcctacctcatctgggacatcatcatagcctcctgcttctactacgtcgccacctcttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34620 - DNA, 439 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtgtgccacgctgagagccagcagcaaatgaaaaatctaaagggggtcaagccgtgggcctggcacagcaccggcaagcaggcgctggagaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 34621 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcaccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 34622 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactggtcctgccaagggtgcgtcctaaccggcgtctgggtcatagcccacgagtgcggccaccacgccttcagcgactac

SEQ ID NO: 34623 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagctactac

SEQ ID NO: 34624 - DNA, 380 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggtcatagcattggatcggatcccgggcccgagaactcaagaaagcaatcccaccgcactgtttcaaacgctccatcccacgctccttctcctcttcgacatcatcatctcctcctcggctcctccctctaccacctctccacagcctacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 34625 - DNA, 428 bp, Artificial
  Mutation in BnaC.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactgtcggtgctgtgccaggcccacggcttgaccccggagcaggtggtggccatcgccagccacgatggcggcaagcaggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34626 - DNA, 277 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagacatcatcatagcctcctgcttctactacatcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34627 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactctcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagctactac

SEQ ID NO: 34628 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcgccctctctcctacttcgcctggcctctctactgggcctgccaagggtgcgtcctaaccggcgtctgggtcatagcccacgagtgcggccaccacgccttcagcgactac

SEQ ID NO: 34629 - DNA, 347 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaatggtgcgtcctaaccggcgtctgggtcatagcccacgagtgcggccaccacgccttcagcgactac

SEQ ID NO: 34630 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 34631 - DNA, 371 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtcggtccagcggctgttgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtaatagcccacgagtgcggccaccacgccttcagcgactac

SEQ ID NO: 34632 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgcctggcctctctactgggcctgccaagggtgcgtcctaaccggcgtctgggtcatagcccacgagtgcggccaccacgccttcagcgactac

SEQ ID NO: 34633 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 34634 - DNA, 356 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgcctggcctctctactgggcctgccaagggtgcgtcctaaccggcgtctgggtcatagcccacgagtgcggccaccacgccttcagcgactac

SEQ ID NO: 34635 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttaaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcctctgggtcatagcccacgagtgcggccaccacgccttcagcgactac

SEQ ID NO: 34636 - DNA, 317 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaagcgcgtaccctgcgagacaccgcccttcactgtcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34637 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaatcgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34638 - DNA, 333 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 34639 - DNA, 445 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggcaggtggtggccatcgccagcaatggcggtggcaagcaggcgctggagacggtccagcggctgttgccggtgctgtgccaggcccacggctagacctcaagaaagcaatcccaccgcactgtttcaaacgctcgatccctcgctctttctcctacctcatctgggacatcatcatagcctcctgcttctactacgtcgccaccacttacttacctctcctccctcaccctctctcctacttcgcctggcatctctactgggcctgccaagggtgcgtcctaaccggcgtctgggtcatagcccacgagtgcggccaccacgccttcagcgactac

SEQ ID NO: 34640 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcggggtcatagcccacgagtgcggccaccacgccttcagcgactac

SEQ ID NO: 34641 - DNA, 343 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 34642 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctatctactgggcctgccaagggtgcgtcctaacgggcctctgggtcatcgcccacgaatgcggccaccacgccttcagcgactac

SEQ ID NO: 34643 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 34644 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctaccttatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34645 - DNA, 385 bp, Artificial
  Mutation in BnaC.FAD2.a introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactgtcgggtcagggtgccggccttgatcatctcgccgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34646 - DNA, 356 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34647 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaacctacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 34648 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctacgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34649 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctcaatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34650 - DNA, 357 bp, Artificial
  Mutation in BnaC.FAD2.a introduced by TALE nuclease pair BnFAD2_T03
caggatccatgggtgcaggcggaagaatgcaagtgtctcctccctccaagaagtctgaaaccgacaccatcaagcgcgtaccctgcgagacaccgcccttcactgtttttgttagaactcaagaaagcaatcccaccgcactgtttcaaacgctcgatccctcgctctttctcctacctcatctgggacatcatcatagcctcctgcttctactacgtcgccaccacttacttccctctcctccctcacccgctctcctacttcgcctggcctctctactgggcctgccaagggtgcgtcctaaccggcgtctgggtcatagcccacgagtgcggcctccacgccttcagcgactac

SEQ ID NO: 34651 - DNA, 350 bp, Artificial
  Mutation in BnaC.FAD2.a introduced by TALE nuclease pair BnFAD2_T03
caggatccatgggtgcagggggaagaatgcaagtgtttcctccctccaagaagtctgaaaccgacaccatcaagcgcgtcccctgcgaaacaccacccttcactctagacctcaagaaagcaatcccacctcactgcttcaaacgctccatccctcgctctttctcctacctcatctgggacatcatcatagcctcctgcttctactacgtcgccaccacttacttccctctcctccctctccctctctcctccttcgcctggcctctctactgggcctgccaagggtgcgtcctaactggcgtcttggtcatagcccacgagtgctgccgccgcgccttcatcgactac

SEQ ID NO: 34652 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcacgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34653 - DNA, 338 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34654 - DNA, 376 bp, Artificial
  Mutation in BnaC.FAD2.a introduced by TALE nuclease pair BnFAD2_T03
caggatccatgggtgcaggtagaagaatgcaagtgtctcctccatccaagaagtctgaaaccgacacaatcaagcgcgtaccctgcgagacaccgcccttcactgtcggttacgtgccccacgagtacatcgagctgatcgagatagaccggaacagcaatgtttcaaacgctcgatccctcgctctttctcctacctcatctgggacatcatcatagcctcctgcttctactacgtcgccaccacttacttccctctcctccctctccctctctcctacttcgcctggcctctctactgggcctgccaagggtgcgtcctaaccggcgtctggttcatagcccacgagtgcggccaccacgccttcagcgactac

SEQ ID NO: 34655 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgtcaaggctgcgtcctaacgggcctctgggtcatcgcccacgaatgcggccaccacgccttcagcgactac

SEQ ID NO: 34656 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatcgcccacgaatgcggccaccacgccttcagcgactac

SEQ ID NO: 34657 - DNA, 467 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggtggtttttttgtttgcaagcagcagattacgcgcaaaaagcaacggcccggaggggggcgggcaggacgcccgccataaactgccaggcatcaaactaagcagaaaggccatccagaactcaagaaagcaatcccaccgcactgtttcaatcgctcgatccctcgctctttctcccacctcatctgggacatcatcatagcctcctgcttctactacgccgccaccacttacttccctctcctccctcaccctctctcctacttcacctggcctctctactgggcctgccaagggtgcgtcctaaccggcgtcggggtcatagcccacgagtgcggccaccacgccttcagcgactac

SEQ ID NO: 34658 - DNA, 394 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgccggtgctgtgccaggcccacggcttgaccccccagcaggtggtgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34659 - DNA, 348 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgttactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcggggtcatagcccacgagtgcggccaccacgccttcagcgactac

SEQ ID NO: 34660 - DNA, 341 bp, Artificial
  Mutation in BnaC.FAD2.a introduced by TALE nuclease pair BnFAD2_T03
caggatccatgggttcaggtggaagaatgcaagtgtctcctccctccaagaagtctgaaaccgacaccatcaagcgcgtaccctgcgagacaccgcccttcactgagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcctctctactgggcctgccaagggtgcgtcctaaccggcgtctgggtcatagcccacgagtgcggccaccacgccttcagcgactac

SEQ ID NO: 34661 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccaacatcgccaggcctctctactgggcctgccaagggtgcgtcctaaccggcgacggggacatagcccacgagtgcggccaccacgccttcagcgactac

SEQ ID NO: 34662 - DNA, 382 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgatagttgagtcgatacttcggcgatcaccgctgaactcaagaaagcaatcccaccgcactgtttcaaacgctcgatccctcgctctttctcctacctcatctgggacatcatcatagcctcctgcttctactacgtcgccaccgcttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34663 - DNA, 346 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacgacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34664 - DNA, 454 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaccgtctccagcgcctgcttgccaccaatattgctggcgatggccaccacctgctccggggtcaagccgtgggcctggcacagcaccggcaacagccgctggagaagaactcaagaaagcaatcccaccgcactgtttcaaacgctcgatccctcgctctttctcctacctcatctggaccatcatcatagcctcctgcttctactacgtcgccaccccttacttccctctcctccctcaccctctctcctacttcgcctggcctctctactgggcctgccaagggtgcgtcctaaccggcgtctgggtcatatcccacgagtgcggccaccacgccttcagcgactac

SEQ ID NO: 34665 - DNA, 373 bp, Artificial
  Mutation in BnaC.FAD2.a introduced by TALE nuclease pair BnFAD2_T03
caggatccatgggtgcaggtgaaagaatgcaagtgtctcctccctccaagaagtctgaaaccgacaccatcaagcgcgtaccctgcgagacactgccaggcatcaaactaagcagaaggccatccgtcaaacgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 34666 - DNA, 350 bp, Artificial
  Mutation in BnaC.FAD2.a introduced by TALE nuclease pair BnFAD2_T03
caggatccatgggcgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgacccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 34667 - DNA, 348 bp, Artificial
  Mutation in BnaC.FAD2.a introduced by TALE nuclease pair BnFAD2_T03
caggatccatgggtgcaggaggaagaatgcaagtgtctccaccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34668 - DNA, 349 bp, Artificial
  Mutation in BnaC.FAD2.a introduced by TALE nuclease pair BnFAD2_T03
caggatccatgggtgcaggtggatgaatgcaagtgtctcctccctccaagaagtctgaaaccgacaccatcaagcgcgtaccctgcgagacaccgcccttcactgagaactcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34669 - DNA, 345 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacacctcaagaaagcaatcccaccgcactgtttcaaacgctcgatccctcgctctttctcctacctcatctgggacatcatcatagcctcctgcttctactacgtcgccaccacttacttacctctcctccctcaccctctctcctacttcgcctggcctctctactgggcctgccaagggtgcgtcctaaccggcgtctgggtcatagcccacgagtgtggccaccacgccttcagcgactac

SEQ ID NO: 34670 - DNA, 416 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttagttaccggataaggcgcagcggtcgggctgaacgggggtgtagatggcgccgtcgggcttcgaaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34671 - DNA, 350 bp, Artificial
  Mutation in BnaC.FAD2.a introduced by TALE nuclease pair BnFAD2_T03
caggttccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcataacccacgagtgcggccaccacgccttcagcgactac

SEQ ID NO: 34672 - DNA, 395 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgggtcaagccgtgggcctgacacagcaccggcaacagccgctggagagacctcaagaaagcaatcccacctcactgcttcaaacgctcgatccctcgctctttctcctacctcatctggtacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34673 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccacctcactgcttcaaacgctcgatccctcgctctttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34674 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 34675 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaagaactcacgaaagcaatcccaccgcactgtttcaaacgcacgatccctcactctctctcctacctcatctgggacatcatcataccctcctgcttctactacgtcgccaccacttacttccctctcctccctcaccctctctcctactacgcctggcctctctactgggcctgccaagggtgcgtcctaaccggcgtctgggtcatagcccacgagtgcggccaccacgccttcagcgactac

SEQ ID NO: 34676 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcagactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagggcggccaccacgccttcagcgactac

SEQ ID NO: 34677 - DNA, 409 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggccagttaccttcggaaaaagagttggtagctcttgatccggcaaacaaaccaccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 34678 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatagcccacgagtgcggccaccacgccttcagcgactac

SEQ ID NO: 34679 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaaccctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34680 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagtccacgagtgcggccaccacgccttcagcgactac

SEQ ID NO: 34681 - DNA, 421 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaccgtctccagcgcctgcttgccggtgctgtgccgccatcgtggctggcgatggccaccacctgctccggggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34682 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34683 - DNA, 342 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 34684 - DNA, 341 bp, Artificial
  Mutation in BnaC.FAD2.a introduced by TALE nuclease pair BnFAD2_T03
caggatccatgggtgcaggtgaaagaatgcaagtgtctcctccctccaagaagtctgaaaccgacaccatcaagcgcgtaccctgcgagacaccgcccttcatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34685 - DNA, 351 bp, Artificial
  Mutation in BnaC.FAD2.a introduced by TALE nuclease pair BnFAD2_T03
caggatccatgggtgcaggtcgaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34686 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcgcctggcctctctactgggcctgccaagggtgcgtcctaaccggcgtctgggtcatagcccacgagtgcggccaccacgccttcagcgactac

SEQ ID NO: 34687 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactgcgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34688 - DNA, 419 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttgtccagcggctgttgccggtgctgtgccaggcccacggcttgacccctcagcaggtggtggccatcggagaactcaagaaagcaatcccaccgcactgtttcaaacgctcgatccctcgctctttctcctacctcatcttggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34689 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34690 - DNA, 347 bp, Artificial
  Mutation in BnaC.FAD2.a introduced by TALE nuclease pair BnFAD2_T03
caggatccatgggtgcaggtggaagaatgcaagtgtctcctcactccaaaaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34691 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccctcaagcgcgtaccctgcgagacaccgcccttcactgtaaactcaagcaagcaatcccaccgcactgtttcaaacactcgatccctcgctctttctcctacctcatctgggacatcatcatatcctcctgcttctactacgtcaccaccacttacttccctctcctccctcaccctctctcctacttcgcctggcccctctactgggcctgccaagggtgcgtcctaaccggcgtctgggtcatagcccacgagtgcggccaccacgccttcagcgactac

SEQ ID NO: 34692 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccacctcactgcttcaaacgctcgatccctcgctctttctcctacctcatctgggacatcatcatagcctcctgcttctactacgtcgccaccacttacttccctctcctccctcaccctctcccctacttcgcctggcctctctactgggcctgccaagggtgcgtcctaaccggcgtctgggtcatcgcccacgagtgcggccaccacgccttcagcgactac

SEQ ID NO: 34693 - DNA, 342 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacccctccctccaagtgtctcctccctcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34694 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccaccgcactgtttcaaacgctcgatccctcgctctttctcctacctcatctgggacatcatcatagcctcctgcttctactatgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34695 - DNA, 333 bp, Artificial
  Mutation in BnaC.FAD2.a introduced by TALE nuclease pair BnFAD2_T03
caggatccatgggtgcaggtggaagaatgcaagtgcctcctccctccaagaagtctgaaaccgagcccccgatttagagcttgacggggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34696 - DNA, 280 bp, Artificial
  Mutation in BnaC.FAD2.a introduced by TALE nuclease pair BnFAD2_T03
caggatccatgggtgcaggcggaagaatgcaagtgtctcctccctccaagaagtctgaaaccgacaccatcaagcgcgtaccctgcgagacaccgcccttcactgtcgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34697 - DNA, 342 bp, Artificial
  Mutation in BnaC.FAD2.a introduced by TALE nuclease pair BnFAD2_T03
caggatccatgggtgcaggtggaagattgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 34698 - DNA, 372 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 34699 - DNA, 438 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttcgttggtcaacgcggccaacgccggatcagggcgagataactgggcaacaatgctctccagcgcctgttgccggtgctgtgccaggccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34700 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcagacctcaagaaagcaatcacacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34701 - DNA, 319 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgccctccactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34702 - DNA, 350 bp, Artificial
  Mutation in BnaC.FAD2.a introduced by TALE nuclease pair BnFAD2_T03
caggatccatgggtgcaggtggaagaatgcaagtctctcctcactccagctcccccgaaaccaaaaccctcaaacgcgtcccctgcgagacaccacccttcactcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgcctgcagcgactac

SEQ ID NO: 34703 - DNA, 338 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcaagaacgcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34704 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagggcggccaccacgccttcagcgactac

SEQ ID NO: 34705 - DNA, 347 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccaccgcactgtttcaaacgctcgatccctcgctctttctcctacctcatctgtgacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34706 - DNA, 338 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34707 - DNA, 347 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttacctcaagaaagcaatcccaccgcactgtttcaaacgctcgatccctcgctctttctcctacctcatctaggacatcatcatagcctcctgcttctactacgtcgccaccacttacttccctctcctccctcaccctctctcctacttcccctggcctctctactgggcctgccaagggtgcgtcctaaccggcgtctgggtcatagcccacgagtgcggcctccacgccttcagcgactac

SEQ ID NO: 34708 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34709 - DNA, 319 bp, Artificial
  Mutation in BnaC.FAD2.a introduced by TALE nuclease pair BnFAD2_T03
caggatccatgggtgcaggtggaagaatgcaagtctctcctccctccagctcccccggaaccgacaccatcaagcgcgtaccctgcgagacaccgccctccactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34710 - DNA, 344 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34711 - DNA, 413 bp, Artificial
  Mutation in BnaC.FAD2.a introduced by TALE nuclease pair BnFAD2_T03
caggatccatgggtgcaggtggaagaatgcaagtgtctcccccctccaagaagtctgaaaccgacaccatcaagcgcgtaccctgcgagacaccgcccttcactgtcggccatcgccagcaatggtggtggcaagcaggcgctggagacggtccagcggctgttgccggagaactcaagaaagcaatcccaccgcactgtttcaaacgctcgatccctcgctctttctcctacctcatctgggacatcatcatggcctcctgcttctaccacgtcgccacctcttacttccctcgcctcccccaccctctcccttacctcgcctggcccctctactgggcctgccaaggctgcgtcctaacgggcctctgggtcatcgcccacgaatgcggccaccgcgccttcagcgactac

SEQ ID NO: 34712 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctagcgggcctctgggtcatcgcccacgaatgctgccaccacgccttcagcgactac

SEQ ID NO: 34713 - DNA, 465 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggaccgagatagggttgagtgttgttccagtttggaacaagagtccactattaaagaacgtggactccaacgtcaaagggcgaaaaaccgtctatcagggcgatggttcacgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34714 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34715 - DNA, 343 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 34716 - DNA, 406 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggctggcgatggccaccacctgccggggggtcaagccgtgggcctggcacagcaccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgacgac

SEQ ID NO: 34717 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgacctcaagaaagcaatcccaccgcactgtttcaaacgctcgatccctcgctctttctcctacctcatctgggacatcatcatcgcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 34718 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccaccgcactgtttcaaacgctcaatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34719 - DNA, 400 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcggcctttttacggttcctggccttttgctggccttttgctcacatgttctttcctgcgttatcccccgggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 34720 - DNA, 416 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccagcaatattggtggcaacgaacaggtcactatcagtcaaaataaaatcattatttgccatgtacgaagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34721 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactggacctgccaagggtgcgtcctaaccggcgtctgggtcatagcccacgagtgcggccaccacgccttcagcgactac

SEQ ID NO: 34722 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 34723 - DNA, 354 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtcggaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34724 - DNA, 343 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccctagacctcaagaaagcaatcccacctcactgtttcaaacgctcgatccctcgctctttctcctacctcatctgggacatcatcatagcctcctgcttctactacgtcgccaccgcttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 34725 - DNA, 301 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 34726 - DNA, 443 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcggtcataatgtttttggtacaaccgatttagctttatgctctgaggcttagaccgagatagggttgagtgttgttccagtttggaacaagagtccactatttaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34727 - DNA, 465 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggaccgcgctagggttgagtgctgtcccagtttggaacaagagcccactattaaagaatgtggactccaacgtcaaagggcgaaaaaccgtctatcatggcgatggtccacgcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34728 - DNA, 356 bp, Artificial
  Mutation in BnaC.FAD2.a introduced by TALE nuclease pair BnFAD2_T03
caggatccatgggtgcaggtggaagaatgcaagtgtatcctcactccaggacgtctgaaaccgacaccatcaagcgcgtaccctgcgagacaccgcccttcactgtcggcggagaactcaagaaagcaatccctcctcacttcttcaaatgctccatccctcgctctttctcctacctcatctgggacatcatcatatcctcctgcttctactacgtctccgccgcttacttccctctcctccctcaccctctaacgaacttcgcctggggtcactactggtcctgccatgactgcgtcctaaccggcgtcggggtcatagcccacgagtgcggccaccacgcctgcagcgactac

SEQ ID NO: 34729 - DNA, 319 bp, Artificial
  Mutation in BnaC.FAD2.a introduced by TALE nuclease pair BnFAD2_T03
caggatccatgggtgcaggtggaagaatgcaagtctctcctccctccagctcccccggaaccgacaccatcaagcgcgtaccctgcgagacaccacccttcactgtttcaaacgctcgatccctcgctctttcttctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 34730 - DNA, 343 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcacacgctcgatccctcgctctttctcctacctcatctgggacatcatcatctcctcctcggctcctccctctaccacctctccacagcctacttccctcgcccttacctcgcctgacccctctactgggcctgccaaggctgcggcctaacgggcctcggggtcatcgcccacgaatgcggccaccacgccttcagcgactac

SEQ ID NO: 34731 - DNA, 333 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgagcccccgatttagagcttgacggggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgcaaagggtgcgtcctaaccggcgtctgggtcatagcccacgagtgcggccaccacgccttcagcgactac

SEQ ID NO: 34732 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 34733 - DNA, 334 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctcgatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 34734 - DNA, 308 bp, Artificial
  Mutation in BnaC.FAD2.a introduced by TALE nuclease pair BnFAD2_T03
caggatccatgggtgcaggtggaagaatgcaagtgtctcctccctcaaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34735 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34736 - DNA, 305 bp, Artificial
  Mutation in BnaC.FAD2.a introduced by TALE nuclease pair BnFAD2_T03
caggatccatgggtgcaggtggaagaatgcaagtgtctcctcactccaagaagtctgaaaccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggcctccacgcctgcagcgactac

SEQ ID NO: 34737 - DNA, 350 bp, Artificial
  Mutation in BnaC.FAD2.a introduced by TALE nuclease pair BnFAD2_T03
caggatccatgggtgcagctggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatatcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34738 - DNA, 351 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34739 - DNA, 419 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcccacggcttgaccccccagcaggtggtggccatcgccagcaataatggtggcaagcaggcgctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34740 - DNA, 348 bp, Artificial
  Mutation in BnaC.FAD2.a introduced by TALE nuclease pair BnFAD2_T03
caggatccatgggtgcaggtagaagaatgcaagtgtctcctcactccaagaagtctgaaaccgacaccatcaagcgcgtaccctgcgagacaccgcccttcactataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccatgggtgcgtcctaaccggcgtctgggtcatagcccacgagtgcggccaccacgccttcagcgactac

SEQ ID NO: 34741 - DNA, 351 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttaagcgactac

SEQ ID NO: 34742 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccggccaagggtgcgtcctaaccggcgtctgggtcatagcccacgagtgcggccaccacgccgtcagcgactac

SEQ ID NO: 34743 - DNA, 348 bp, Artificial
  Mutation in BnaC.FAD2.a introduced by TALE nuclease pair BnFAD2_T03
caggatccatgggtgcaggtagaagaatgcaagtgtctcctccccccaaaaagtctgaaaccgacaccatcaagcgcgtaccctgcgcgacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcctctctactgggcctgccaagggtgcgtcctaaccggcgtctgggtcatagcccactagtgctgccaccacgccttcatcgactac

SEQ ID NO: 34744 - DNA, 348 bp, Artificial
  Mutation in BnaC.FAD2.a introduced by TALE nuclease pair BnFAD2_T03
caggatccatggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacctgcgtctgggtcatagcccacgagtgcggccaccacgccttcagcgactac

SEQ ID NO: 34745 - DNA, 351 bp, Artificial
  Mutation in BnaC.FAD2.a introduced by TALE nuclease pair BnFAD2_T03
caggatccatgtgtgcaggtggaagaatgcaagtgtctcctccctcaaagaagtctgaaaccgacaccatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcggggtcatagcccacgagtgcggccaccacgccttcagcgactac

SEQ ID NO: 34746 - DNA, 419 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttgtccagcggctgttgccggtgctgtgccaggcccacggcttgaccccccagcaggtggtggccatcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 34747 - DNA, 410 bp, Artificial
  Mutation in BnaC.FAD2.a introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctacaggcccacggcttgaccccccagcaggtggtggccatcgccagcaataatggtggcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34748 - DNA, 342 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 34749 - DNA, 469 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggtgctgtgccaggcccacggcttgaccccccagcaggtggtggccatcgccagcaatggcggtggcaacagccgctggggcagcagccactggtaacaggattcagggcaagccttaagaactccagaaagcaatcccaccgcactgtttccaacgctcgatccctcgctctttctcctacctcatctgggacatcatcatagcctcctgcttctactacgtcgcccccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34750 - DNA, 402 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtccagcgcctgcttgccgccatcgtggctggcgatggccaccacctgctccggagaactcaagaaagcaatcccaccgcactgtttcaaacgctcgatccctcgctctttctcctacctcatctgggacatcatcatagcctcctgcttcgactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34751 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccggccaagggtgcgtcctaaccggcgtcggggtcatagcccacgagtgctgccaccacgccttcagcgactac

SEQ ID NO: 34752 - DNA, 280 bp, Artificial
  Mutation in BnaC.FAD2.a introduced by TALE nuclease pair BnFAD2_T03
caggatccatgggtgcaggtggaagaatgcaagtgtctcctccatccaagaagtctgaaaccgacaccatcaagcgcgtaccctgcgagacaccgcccttcactgtcgggacatcatcatagcctcctgcttctactacgtcgccaccacttacttccatctcctccctcaccctctctcctacttcgcctggcctctctactgggcctgccaagggtgcgtcctaacgggcctctgggtcatcgcccacgaatgcggccaccacgccttcagcgactac

SEQ ID NO: 34753 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacacctcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 34754 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34755 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 34756 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtccgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34757 - DNA, 337 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 34758 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccaccaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34759 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttgagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 34760 - DNA, 351 bp, Artificial
  Mutation in BnaC.FAD2.a introduced by TALE nuclease pair BnFAD2_T03
caggatccatgggtgcagggggaagaatgcaagtgtctcctccctccaagaagtctgaaaccgacaccatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccggccaagggtgcgtcctaacgggcctctgggtcatagcccacgagtgcggccgccacgccttcagcgactac

SEQ ID NO: 34761 - DNA, 268 bp, Artificial
  Mutation in BnaC.FAD2.a introduced by TALE nuclease pair BnFAD2_T03
caggatccacgggtgcaggtggaagaatgcaagtgtctcctccctccaagaagtctgaaaccgacaccatcaagcgcgtaccctgcgagacacagcccttctcctacctcatctgggacatcatcatagcctcctgcttctaccacctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34762 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcgcccaccacgccttcagcgactac

SEQ ID NO: 34763 - DNA, 437 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtctccagcgcctgcttgccaccattattgctggcgatggccaccacctgctggggggtcaagttgagcggggcacccgtcagtgcatgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34764 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcatctgggtcatagcccacgagtgcggccaccacgccttcagcgactac

SEQ ID NO: 34765 - DNA, 347 bp, Artificial
  Mutation in BnaC.FAD2.a introduced by TALE nuclease pair BnFAD2_T03
caggattgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34766 - DNA, 377 bp, Artificial
  Mutation in BnaC.FAD2.a introduced by TALE nuclease pair BnFAD2_T03
caggatccatgggtgcaggtggaagaatgcaagtgtatacaccctccaagaagtctgaaaccgacaccatcaagcgagtaccctgcgagacaccgcccttcactgtagaactcaagaaagcaatcccaccgcactgtttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgtgtcatagcccacgagtgcggccaccacgccttcagcgactac

SEQ ID NO: 34767 - DNA, 350 bp, Artificial
  Mutation in BnaC.FAD2.a introduced by TALE nuclease pair BnFAD2_T03
caggatccattggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccatggctgcgtcctaaccggcgtctgggtcatagcccacgagtgcggccaccacgccttcagcgactac

SEQ ID NO: 34768 - DNA, 295 bp, Artificial
  Mutation in BnaC.FAD2.a introduced by TALE nuclease pair BnFAD2_T03
caggatccatgggtgcaggtggaagaatgcaagtgtctcctcactccaagaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34769 - DNA, 349 bp, Artificial
  Mutation in BnaC.FAD2.a introduced by TALE nuclease pair BnFAD2_T03
caggatccatggtgcaggtggaagaatgcaagtctctcctccctccagctcccccggaaccaacaccctcaaacgcgtcccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34770 - DNA, 346 bp, Artificial
  Mutation in BnaC.FAD2.a introduced by TALE nuclease pair BnFAD2_T03
caggatccatgggtgcaggtggaagaatgcaagtgtctaatctcacaaagaagtctgaaaccgacaccatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatctcccacgaatgcggccaccacgccttcagcgactac

SEQ ID NO: 34771 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctactacttcgcctggcctctctactgggcctgccaagggtgcgtcctaaccggcgtctgggtcatagcccacgagtgcggccaccacgccttcagcgactac

SEQ ID NO: 34772 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggttatcgcccacgaatgcggccaccacgccttcagcgactac

SEQ ID NO: 34773 - DNA, 349 bp, Artificial
  Mutation in BnaC.FAD2.a introduced by TALE nuclease pair BnFAD2_T03
caggatccatgggtgcaggtagaagaatgcaagtgtctactcactccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgcctgggtcatagcccacgagtgcgtccaccacgcctgcatcgactac

SEQ ID NO: 34774 - DNA, 350 bp, Artificial
  Mutation in BnaC.FAD2.a introduced by TALE nuclease pair BnFAD2_T03
caggatccatgggtgcaggtggaagaatgcaagtctatcctccctccagctcccccggaaccaacaccctcaaacgcgtcccctgcgagacaccaccattcactcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccatcagcgactac

SEQ ID NO: 34775 - DNA, 399 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttgggggatcctatcagccgttcccagctggtgaagtccgagctggaggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 34776 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccaacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctcaccggcgtctgggtcatagcccacgagtgcggccaccacgccttcagcgactac

SEQ ID NO: 34777 - DNA, 411 bp, Artificial
  Mutation in BnaC.FAD2.a introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcagccgaacgaccgagcgcagcgagtcagtgagcgaggaagcggaagagcgcccaatacgcggagacctcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 34778 - DNA, 385 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgaggcttgttgtgaagggattccaacaaaaagtaggcgagaactcaagaaagcaatcccaccgcactgtttcaaacgctcgatccctcgctctttctcctacctcatctgggacatcatcatagcctcctgcttctactacgtcgcccccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34779 - DNA, 440 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggaagactgagcctttcgttttatctgttgtttgtcggtgaacgctctcctgagtaggacaaatccgccgggagcggatttgaacgttgtgagacctcaagaaagcaatcccaccgcactgcttcaaacgctccatcccacgctccgtctcctacctcagctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34780 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 34781 - DNA, 341 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 34782 - DNA, 319 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34783 - DNA, 421 bp, Artificial
  Mutation in BnaC.FAD2.a introduced by TALE nuclease pair BnFAD2_T03
caggatccatgggtgcagggggaagaatgcaagtctctcctccctccagctcccccggaaccaacacactcaaacgcgtcccctgcgagacaccgcccttcactgtgcaccggcaacagccgctggaccgtctccagcgcctgcttgccgccatcgtggcgggcgatggccaccacctgaactcaagaaagcaatcccaccgcactgtttcaaacgctcgatccctcgctctttctcctacctcatctgggacatcatcatagcctcctgcttctcctgcgacgccaccacttacctccctctcctccctcaccctctctcctacttcgcctggcctctctactgggccggccaagggtgcgtcctaaccggcgtctgggtcatagcccacgagggcggccaccacgccttcagcgactac

SEQ ID NO: 34784 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccctccactgtttcaaacgctcgatccctcgctctttctcctacctcatctgggacatcatcatagcctcctgcttctactacgtcgccaccacttacttccctctcctccctcaccctctctcctacttcgcctggcctctctaccgggcctgccaagggtgcgtcctaacgggcctctgggtcatcgcccacgagtgcggccaccacgccttcagcgactac

SEQ ID NO: 34785 - DNA, 334 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctccatccctcgctccttctcctacctcctcttcgacatcctcgtctcctcctccctctaccacctctccacagcctacttccctctcccttacctcgcctggcccctctactgggcctgccaaggctgcgtcctaaccggcgtctgggtcatagcccacgagtgcggccaccacgccttcagcgactac

SEQ ID NO: 34786 - DNA, 352 bp, Artificial
  Mutation in BnaC.FAD2.a introduced by TALE nuclease pair BnFAD2_T03
caggatccatggggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34787 - DNA, 348 bp, Artificial
  Mutation in BnaC.FAD2.a introduced by TALE nuclease pair BnFAD2_T03
caggatccatgggtgcaggtggaagaatgcaagtgtctaatccctccaaaaagtctgaaaccgacaccatcatgcgcgtaccctgcgagacaccgcccttcactataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34788 - DNA, 341 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34789 - DNA, 350 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagaactcaagaaagcaatcccaccgcactgtttcaaacgctccatcccacgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34790 - DNA, 409 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgtcggccagttaccttcggaaaaagagttggtagctcttgatccggcaaacaaaccaccggagaactcaagaaagcaatcccaccgcactgtttcaaacgctcgatccctcgctctttctcctacctcatctgggacatcatcatagcctcctgcttctactacgtcgccaccacttacttccctctccgccctcaccctctctcctacttcgcctggcctctctactgggcctgccaagggtgcgtcctaaccggcgtctgggtcatagcccgcgagtgcggccaccacgccttcagcgactac

SEQ ID NO: 34791 - DNA, 419 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtccgactgagcctttcgttttatctgttgtttgtcggtgaacgctctcctgagtaggacaaatccgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgaatgcggccaccacgccttcagcgactac

SEQ ID NO: 34792 - DNA, 344 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcgtctgggtcatagcccacgagtgcggccaccacgccttcagcgactac

SEQ ID NO: 34793 - DNA, 347 bp, Artificial
  Mutation in BnaC.FAD2.a introduced by TALE nuclease pair BnFAD2_T03
caggatccatgggtgcaggtggaagaatgcaagtgtctcctacctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcctctgggtcatagcccacgagtgcggccaccacgccttcagcgactac

SEQ ID NO: 34794 - DNA, 342 bp, Artificial
  Mutation in BnaC.FAD2.a introduced by TALE nuclease pair BnFAD2_T03
caggatccatgggtgcaggtggaagaatgcaagtgtctcctccctacagctcccccgaaaccaaaaccctcaaacgcgtcccctgcgagacaccacccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgtggccaccacgccttcagcgactac

SEQ ID NO: 34795 - DNA, 347 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcatcctaaccggcgtctgggtcatagcccacgagtgcggccaccacgccttcagcgactac

SEQ ID NO: 34796 - DNA, 277 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgatcgagcgtttgaaacagtgcggtgggattgctttcttgagttctccctctcctccctcaccctctctcctacttcgcctggcccctctactgggcctgccaaggctgcgtcctaacgggcctctgggtcatcgcccacgagtgcggccaccacgccttcagcgactac

SEQ ID NO: 34797 - DNA, 350 bp, Artificial
  Mutation in BnaC.FAD2.a introduced by TALE nuclease pair BnFAD2_T03
caggatccatgggtgcaggtggaagaatgcaagtgtctcctcactccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtagccaccacttacttccctctcctccctcaccctctctcctacttcgcctggcctctctactgggcctgccaagggtgcgtcctaaccggcgtctgggtcatagcccacgagtgcggccaccacgccttcatcgactac

SEQ ID NO: 34798 - DNA, 314 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 34799 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34800 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgcgacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccggccaagggtgcgtcctaaccggcgtctgggtcatagcccacgagtgcggccaccacgccttcagcgactac

SEQ ID NO: 34801 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccattaagccacgatggcggcaagcaggcgctggagaactcaagaaagcaatcccaccgcactgtttcaaacgctcgatccctcgctctttctcctacctcatctgggacatcatcatagcctcctgcttctactacgtcgccaccacttacttcccactcctccctcaccctctctcctacttcgcctggcctctctactgggcctgccaagggtgcgtcctaaccggcgtctgggtcatagcccacgagtgcggccaccacgccttcagcgactac

SEQ ID NO: 34802 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34803 - DNA, 401 bp, Artificial
  Mutation in BnaC.FAD2.a introduced by TALE nuclease pair BnFAD2_T03
caggatccatgggcgcaggtggaagaatgcaagtgtctcctccctccaaaaagtctgaaaccgacaccatcaagcgcgtaccctgcgagacaccgcccttcactgtgggccttgtagttgcccttgaagtggccggacacgaacaggaacttgaactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34804 - DNA, 355 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgcggagaactcaagaaagcaaccccaccgcactgtttcaaacgctctatcccgcgctttttctcctacctcatctgggacatcatcatagcctcctgcttctactacgtcgccaccacttacttccctctcctccctcaccctctctcctacttcgcctggcctctctactgggcctgccaaggttgcgtcctaaccggcgtctgggtcatagcccacgagtgcggccaccacgccttcaacgactac

SEQ ID NO: 34805 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgctaccacttacttccctctcctccctcaccctctctcctacttcgcctggcctctctactgggcctgccaagggtgctgcctaaccggcgtcggggtcatagcccgcgagtgcggccaccacgccttcagcgactac

SEQ ID NO: 34806 - DNA, 349 bp, Artificial
  Mutation in BnaC.FAD2.a introduced by TALE nuclease pair BnFAD2_T03
caggatccatgggtgcaggtggaagaatgcaagtgtctactccctcaaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34807 - DNA, 400 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcggcctttttacggttcctggccttttgctggccttttgctcacatgttctttcctgcgttatcccccgggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 34808 - DNA, 347 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacactgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34809 - DNA, 342 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctacgagacaccacccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcatcgactac

SEQ ID NO: 34810 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagctcacgagtgcggccaccacgccttcagcgactac

SEQ ID NO: 34811 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggtctctctactgggcctgccaagggtgcgtcctaaccggcgtctgggtcatagcccacgagtgcggccaccacgccttcagcgactac

SEQ ID NO: 34812 - DNA, 452 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcggtggccatcgccagcaataatggtggcaggtggtggccatcgccagcaatggcggtggcaagcaggcgctggagacggtccagcggctgttgccggtgcgagaactcaagaaagcaatcccaccgcactgtttcaaacgcgcgatcccccgctctttctcctccctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 34813 - DNA, 341 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcatcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 34814 - DNA, 333 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcccttacctcgcctgacccctctactgggcctgccatggctgcgtcctaaccggcgtctgggtcatagcccacgagtgcggccaccacgccttcagcgactac

SEQ ID NO: 34815 - DNA, 352 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtcccctgcgagacaccacccttcactccttagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34816 - DNA, 348 bp, Artificial
  Mutation in BnaC.FAD2.a introduced by TALE nuclease pair BnFAD2_T03
caggatccatgggtgcaggtggaagaatgcaagtgtctcctccctacaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34817 - DNA, 349 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgctgccaccacgccttcagcgactac

SEQ ID NO: 34818 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtaatagcccacgagtgcggccaccacgccttcagcgactac

SEQ ID NO: 34819 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcgcctgacccctctactgggcctgccaaggctgcgtcctaacgggcctctgggtcatagcccacgagtgcggccaccacgccttcagcgactac

SEQ ID NO: 34820 - DNA, 348 bp, Artificial
  Mutation in BnaC.FAD2.a introduced by TALE nuclease pair BnFAD2_T03
caggatccatgggtgcaggtggaagaatgcaagtgtctactccctacaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34821 - DNA, 350 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccggccaagggtgcggcctaaccggcgtctgggtcatagcccacgagtgcggccaccacgccttcagcgactac

SEQ ID NO: 34822 - DNA, 346 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34823 - DNA, 348 bp, Artificial
  Mutation in BnaC.FAD2.a introduced by TALE nuclease pair BnFAD2_T03
caggatccatgggtgcaggtggaagaatgcaagtgtctcctcactccaagaagtctgaaaccgacaccatcaagcgcgtaccctgcgagacaccgcccttcactgaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34824 - DNA, 349 bp, Artificial
  Mutation in BnaC.FAD2.a introduced by TALE nuclease pair BnFAD2_T03
caggatccatgggtgcaggtggaagaatgcaagtgcctcctccctccaagaagtctgaaaccgacaccatcaaacgcgtcccctgcgagacaccacccttcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34825 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacctgcgtctgggtcatagcccacgagtgcggccaccacgccttcagcgactac

SEQ ID NO: 34826 - DNA, 351 bp, Artificial
  Mutation in BnaC.FAD2.a introduced by TALE nuclease pair BnFAD2_T03
caggatccatgggtgcaggcggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 34827 - DNA, 349 bp, Artificial
  Mutation in BnaC.FAD2.a introduced by TALE nuclease pair BnFAD2_T03
caggatccatgggtgcaggtggaagaatgcaagtgtctcctcactccaagaagtctgaaaccgacaccatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34828 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccaccgcactgtttcaaacgctcgatccctcgctctttctcctacctcatctgggacatcatcatagcctcctgcttctactacgtcgccaccacttacttccctctcctccctcaccctctctactacttcgcctggcctctctactgggcctgccaagggtgcgtcctaacgggcctctgggtcatcgcccacgaatgcggccaccacgccttcagcgactac

SEQ ID NO: 34829 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactgtttcaaacgctcgatccctcgctctttcttctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 34830 - DNA, 280 bp, Artificial
  Mutation in BnaC.FAD2.a introduced by TALE nuclease pair BnFAD2_T03
caggatccatgggtgcaggcggaagaatgcaagtgtctcctccctccaagaagtctgaaaccgacaccatcaagcgcgtaccctgcgagacaccgcccttcactgtcgggacatcatcatagcctcctgcttctactacgtcgccaccacttacttccctctcctccctcaccctctctcctacttcgcctggcctctctactgggcctgccaagggtgcgtcctaaccggcgtctgggccatagcccacgagtgcggccaccacgccttcagcgactac

SEQ ID NO: 34831 - DNA, 349 bp, Artificial
  Mutation in BnaC.FAD2.a introduced by TALE nuclease pair BnFAD2_T03
caggatccatgggtgcaggtggaagaatgcaagtgtctcctccatccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34832 - DNA, 277 bp, Artificial
  Mutation in BnaC.FAD2.a introduced by TALE nuclease pair BnFAD2_T03
caggatccatgggtgcaggtggaagaatacaagtgtctactctctccaagaagtctgaaaccgacaccatcaagcgcgtaccctgcgagacaccgcccttcactgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34833 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggggcgtcctaaccggcgtctgggtcatagcccacgagtgcggccaccacgccttcagcgactac

SEQ ID NO: 34834 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgaactcaagaaagcaatcccatcgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34835 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcttcgcctggcctctctactgggcctgccaagggtgcgtcctaaccggcgtctgggtcatagcccacgagtgcggccaccacgccttcagcgactac

SEQ ID NO: 34836 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatagcccacgagtgcggccaccacgccttcagcgactac

SEQ ID NO: 34837 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34838 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatggcccacgagtgcggccaccacgccttcagcgactac

SEQ ID NO: 34839 - DNA, 350 bp, Artificial
  Mutation in BnaC.FAD2.a introduced by TALE nuclease pair BnFAD2_T03
caggatccatgggtgcaggtggaagaatgcaagtgtctcatccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcagagcccacgagtgcggccaccacgccttcagcgactac

SEQ ID NO: 34840 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccctcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcgtagcccacgagtgcggccaccacgccttcagcgactac

SEQ ID NO: 34841 - DNA, 341 bp, Artificial
  Mutation in BnaC.FAD2.a introduced by TALE nuclease pair BnFAD2_T03
caggatccatgggtgcaggtggaagaatgcaagtgtctcctcactccaagaagtctgaaaccgacaccatcaagcgcgtaccctgcgagacaccgcccttcatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 34842 - DNA, 412 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgacggatggcctttttgcgtttctacaaactcttcctggctagcggtacgcgtattaattgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgtgtcatagcccacgagtgcggccaccacgccttcagtgactac

SEQ ID NO: 34843 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34844 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaacccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggggcggcctaaccggcgtctgggtcatcgcccacgaaggcggccaccacgccatcagcgactac

SEQ ID NO: 34845 - DNA, 413 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggatgggaaacgatccaatgaagccaaacgatatagtgactggatatgctgtgttttacagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaggggtgcgtcctaaccggcgtctgggtcatagcccacgagtgcggccaccacgccttcagcgactac

SEQ ID NO: 34846 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaattccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34847 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacctgcgtctgggtcatagcccacgagtgcggccaccacgccttcagcgactac

SEQ ID NO: 34848 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaagggtgcgtcctaaccggcgtctgggtcatagcccacgagtgcggccaccacgccttcagcgactac

SEQ ID NO: 34849 - DNA, 380 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcaagacaccgcccttcactgtcgatggccaccacctgctccggggtcaagccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34850 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgaactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34851 - DNA, 348 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 34852 - DNA, 454 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacactgcccttcactcaccgtctccagcgcctgcttgccaccaatattgctggcgatggccaccacctgctccggggtcaagccgtgggcctggcacagcaccggcaacagccgctggagaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34853 - DNA, 350 bp, Artificial
  Mutation in BnaC.FAD2.a introduced by TALE nuclease pair BnFAD2_T03
caggatccatgggtgcaggtggaagaatgcaagtgtctcctccctacaagaagtctgaaaccgacaccataaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccttccaagggtgcgtcctaacgggcctctgggtcatcgcccacgaatgcggccaccacgccttcatcgactac

SEQ ID NO: 34854 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgctctgtttcaaacgctcgatccctctctctttctcctacctcatctggtacatcatcatagcctcctgcttctactacgtcgccaccacttacttccctctcctccctcaccctctctcctacctcgcctggcctctctactgtgcctgccaagggtgcgacctaaccggcgtctggttcatagcccacgagggcggccaccacgccttcagcga

SEQ ID NO: 34855 - DNA, 349 bp, Artificial
  Mutation in BnaC.FAD2.a introduced by TALE nuclease pair BnFAD2_T03
caggatccatgggtgcaggtggaagaatgcaagtgtctactcactccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34856 - DNA, 384 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccgtccagcggctgttgccggtgttgtgcctggcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34857 - DNA, 459 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgtctccagcggctgttgccggtgctgtgccaggcccacggcttgaccctcagcaggtggtggccatcgccagcaatggcggtggcaagcaggcgctggagacggtccagcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 34858 - DNA, 351 bp, Artificial
  Mutation in BnaC.FAD2.a introduced by TALE nuclease pair BnFAD2_T03
caggatccatgggtgcaggcggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34859 - DNA, 351 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34860 - DNA, 349 bp, Artificial
  Mutation in BnaC.FAD2.a introduced by TALE nuclease pair BnFAD2_T03
caggatccatgggtgcaggtgcaagaatgcaagtgtctcctcaatccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34861 - DNA, 409 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccccctggcttgaccccggagcaggaggtggccatcgccagccacgatggcggcaccagccgctggaccgagccctcaagaaagcaatcccacctcactgcttcaaacgctccatccctcgctccttctcctacctcatctgggacatcatcatcgcctcctgcctctaccacgtcgccaccgcttacttccctctcctcccccaccctctctcctacttcgcctggcctctctactgggcctgccaaggctgcgtcctaacgggcctctgggtcatcgcccacgaatgcggccaccacgccttcagcgactac

SEQ ID NO: 34862 - DNA, 335 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 34863 - DNA, 342 bp, Artificial
  Mutation in BnaC.FAD2.a introduced by TALE nuclease pair BnFAD2_T03
caggatccatgggtgcaggtgaaagaatgcaagtgtctactccctccaagaagtctgaaaccgacaccatcaagcgcgtaccctgcgagacaccgcccttcactgaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 34864 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccaccgcactgtttcaaacgctcgatccctcgctctttctcctacctcatctgggacatcatcatagcctcctgcttctactacgtcgccgccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 34865 - DNA, 349 bp, Artificial
  Mutation in BnaC.FAD2.a introduced by TALE nuclease pair BnFAD2_T03
caggatccatgggtgcaggtgcaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34866 - DNA, 433 bp, Artificial
  Mutation in BnaC.FAD2.a introduced by TALE nuclease pair BnFAD2_T03
caggatccatgggtgcaggtggaagaatgcaagtgtctcctccttccaagaagtctgaaaccgacaccatcaagcgcgtaccctgcgagacaccgcccttcactgtcggcggtggcaagcaggcgctggagacggtccagcggctgttgccggtgctgtgccaggcccacggcttgaccccccagcaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34867 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatagcccacgagtgtggccaccacgccttcagcgactac

SEQ ID NO: 34868 - DNA, 349 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtccgaaccggcgtctggggcatagcccacgagtgcggccgccacgcctcagcgactac

SEQ ID NO: 34869 - DNA, 410 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaaacgcgtcccctgcgagacaccaccattcactctacaggcccacggcttgaccccccagcaggtggtggccatcgccagcaataatggtggcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34870 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 34871 - DNA, 419 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgttgtccagcggctgttgccggtgctgtgccaggcccacggcttgaccccccaacaggtggtggccatcggagaactcaagaaagcaatcccaccgcactgtttcaaacgctcgatccctcgctctttctcctacctcatctgggacatcatcatagccgcctgcttctactacgtcgccaccacttacttccctcgcccccctcaccctctctcctacttcgcctggcctctctactgggcctgccaagggtgcgtcctaaccggcgtcggggtcatagcccacgagtgcggccaccacgccttcagcgactac

SEQ ID NO: 34872 - DNA, 347 bp, Artificial
  Mutation in BnaC.FAD2.a introduced by TALE nuclease pair BnFAD2_T03
caggatccatgggtgcaggtggaagaatgcaagtgtctactcactccaaaaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 34873 - DNA, 333 bp, Artificial
  Mutation in BnaC.FAD2.a introduced by TALE nuclease pair BnFAD2_T03
caggatccatgggtgcaggtggaagaatgcaagtgtctcctccctctaagaagtctgaaaccgacaacatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcccttacctcgcctgacccctctactgggcctgccaagggtgcgtcctaaccggcgtctgggtcatagcccacgagtgcggccaccacgccttcagcgactac

SEQ ID NO: 34874 - DNA, 349 bp, Artificial
  Mutation in BnaC.FAD2.a introduced by TALE nuclease pair BnFAD2_T03
caggatccatgggtgcaggtggaagaatgcaagtggcaactccctcaaagaagtctgaaaccgacaccataaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34875 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgcgacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagggcggccaccacgccttcagcgactac

SEQ ID NO: 34876 - DNA, 327 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttccccaccgcactgtttcaaacgctcgatccctcgctctttctcctacctcatctgggacatcatcatagcctcctgcttctactacgtcgccaccacttacatccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34877 - DNA, 430 bp, Artificial
  Mutation in BnaC.FAD2.a introduced by TALE nuclease pair BnFAD2_T03
caggatccatgggtgcaggtgcaagaatgcaagtgtctcctccctccaagaagtctgaaaccgacaccatcaagcgcgtaccctgcgagacaccgcccttcactgtcgctgtgcctggcccgcggcttgaccccccagcaggtggtggccatcgccagcaatggcggtggcaagcaggcgctggagagaactcaagaaagcaatcccaccgcactgtttcaaacgctcgatccctcgctctttctcctacctcatctgggacatcatcatagcctcctgcttctactacgtcgccaccacttacttccctctccacccccaccctctcccttacctcgcctggcccctctactgggcctgccaaggctgcgtcctaacgggcgtctgggtcatcgcccacgaatgcggccaccacgccttcagcgactac

SEQ ID NO: 34878 - DNA, 351 bp, Artificial
  Mutation in BnaC.FAD2.a introduced by TALE nuclease pair BnFAD2_T03
caggatccatgggtgcaggtggaagaatgcaagtgtcacctccctcaaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacggacctctgggtcatcgcccacgaatgcggccaccacgccttcagcgactac

SEQ ID NO: 34879 - DNA, 319 bp, Artificial
  Mutation in BnaC.FAD2.a introduced by TALE nuclease pair BnFAD2_T03
caggatccatgggtgcaggtgcaagaatgcaagtctctcctccctccagctcccccgaaaccaaaaccctcaaacgcgtcccctgcgagacaccacccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34880 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggctcctctactgggcctgccaaggctgcgtcctaacgggcctctgggtcatcgcccacgaatgcggccaccacgccttcagcgactac

SEQ ID NO: 34881 - DNA, 352 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacatcacccttcactccctagacctcaagaaagcaatcccaccgcactgtttcaaacgctcgatccctcgctctttctcctacctcatctgggacatcatcatagcctcctgcttctattacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34882 - DNA, 349 bp, Artificial
  Mutation in BnaC.FAD2.a introduced by TALE nuclease pair BnFAD2_T03
caggatccatgggtgcaggtagaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34883 - DNA, 342 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34884 - DNA, 280 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 34885 - DNA, 374 bp, Artificial
  Mutation in BnaC.FAD2.a introduced by TALE nuclease pair BnFAD2_T03
caggatccatgggtgtaggcggaagaatgcaagtgtctcctccatccaagaagtctgaaaccgacaccatcaagcgcgtaccctgcgagacaccgcccttcactaactccagaaacccgcggctgagtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34886 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 34887 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 34888 - DNA, 368 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtagcaatggcggtggctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34889 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 34890 - DNA, 282 bp, Artificial
  Mutation in BnaC.FAD2.a introduced by TALE nuclease pair BnFAD2_T03
caggatccatgggtgcaggtggaagaatgcaagtgtctcctccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcttcagcgactac

SEQ ID NO: 34891 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtagccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34892 - DNA, 350 bp, Artificial
  Mutation in BnaC.FAD2.a introduced by TALE nuclease pair BnFAD2_T03
caggatccatgggtgcaggtgcaagaatgcaagtgtcccctccatccaagaagtctgaaaccgacaccaaccagcgcgtaccctgcgagacaccgcccctcactggagaactcaagaaagcaatcccaccgcactgtttcaaacgctcgatccctcgctctttctcctacctcatctgggacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcgtccaccacgccttcagcgactac

SEQ ID NO: 34893 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34894 - DNA, 349 bp, Artificial
  Mutation in BnaC.FAD2.a introduced by TALE nuclease pair BnFAD2_T03
caggatccatgggtgcaggtggaagaatgcaagtctctcctccctccaagaactctgaaaccgacaccatcaaacgcgtaccctgcgagacaccgcccttcactgagaactcaagaaagcaatcccaccgcactgtttcatacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34895 - DNA, 369 bp, Artificial
  Mutation in BnaC.FAD2.a introduced by TALE nuclease pair BnFAD2_T03
caggatccatgggtgcaggtggaagaatgcaagtgtctcctccctcaaagaagtctgaaaccgacaccatcaagcgcgtaccctgcgagacaccgcccttcactgtacggtggtttgtttgccggagaactcaagaaagcaatcccaccgcactgtttcaaacgctcgatccctcgctctttctcctacctcatctgggacatcatcatagcctcctgcttctactacgtcgccaccacttacttccctctccgccctcaccctctctcctacttcgcctggcctctctactgggcctgccaagggtgcgtcctaaccggcgtctgggtcatagcccacgagtgcggccaccacgccttcagcgactac

SEQ ID NO: 34896 - DNA, 348 bp, Artificial
  Mutation in BnaC.FAD2.a introduced by TALE nuclease pair BnFAD2_T03
caggatccatgggtgcaggtggaagaatgcaagtgtctactcactccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34897 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcacttcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34898 - DNA, 347 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34899 - DNA, 350 bp, Artificial
  Mutation in BnaC.FAD2.a introduced by TALE nuclease pair BnFAD2_T03
caggatccatgggtgcaggtggaagaatgcaagtgtctcctccctcaaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34900 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacacaatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 34901 - DNA, 347 bp, Artificial
  Mutation in BnaC.FAD2.a introduced by TALE nuclease pair BnFAD2_T03
caggatccatgggtgcaggtgaaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34902 - DNA, 411 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgtacgtgccccacgagtacatcgagctgatcgagatcgcccggaacagcacccaggaccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 34903 - DNA, 348 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34904 - DNA, 430 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcgctgtgcctggcccacggcttgaccccccagcaggtggtggccatcgccagcaatggcggtggcaagcaggcgctggagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34905 - DNA, 347 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcacagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34906 - DNA, 333 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcccttacctcgcctgacccctctactgggcctgccaaggctgcgtcctaacgggcctctgggtcatagcccacgagtgcggccaccacgccttcagcgactac

SEQ ID NO: 34907 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaacccgacaccatcaagcgcgtaccctgcgagacaccgcccttcacagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgacgccaggcctctcaactgggcctgccaggggggcgagctaaccggggacagggtcaaagcccacgagggcggccaccacgcctgcagcgactac

SEQ ID NO: 34908 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgagaactcaagaaagcaatcccacctcactgtttcaaacgctcgatccctcgctctttctcctacctcatctggtccatcatcataccctcctgcttctactaccccgcccccacttacttccctcccctccctcaccctctctcctacttcgcctggcctctctactgggcctgccaagggtgcgtcctaaccggcgtctgggtcatagcccacgagtgcggccaccacgccttcagcgactac

SEQ ID NO: 34909 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggaactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 34910 - DNA, 326 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34911 - DNA, 290 bp, Artificial
  Mutation in BnaC.FAD2.a introduced by TALE nuclease pair BnFAD2_T03
caggatccatgggtgcaggtggaagaatgcaagtctctcctctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34912 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccatcacgccttcagcgactac

SEQ ID NO: 34913 - DNA, 357 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttttgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccggccaagggtgcggcctaaccggcgtctgggtcatcgcccacgaatgcggccaccacgccttcagcgactac

SEQ ID NO: 34914 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggccgctctactgggcctgccaagggtgcggcctaaccggcgtctgggtcatagcccacgagtgcggccaccacgccttcagcgactac

SEQ ID NO: 34915 - DNA, 443 bp, Artificial
  Mutation in BnaC.FAD2.a introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactctcagcggcggaggaactctttgatccggttcctgaacaggctctatttgaggcgctaaatgaacccttaacgctatggaactcgccgcccgactggacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34916 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 34917 - DNA, 347 bp, Artificial
  Mutation in BnaC.FAD2.a introduced by TALE nuclease pair BnFAD2_T03
caggatccatgggtacaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34918 - DNA, 351 bp, Artificial
  Mutation in BnaC.FAD2.a introduced by TALE nuclease pair BnFAD2_T03
caggatccatgggtgctggtggaagaatgcaagtgtctcctccctccaagaagtctgaaaccgacaccatcaagcgcgtaccctgcgagacaccgcccttcactgtgagaactcaagaaagcaatcccaccgcactgtttcaaactctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34919 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactaaagaaagcaatcccaccgcactgtttcaaacgctcgatccctcgctctttctcctacctcagctgggacatcatcatagcctcctgcttctactacgtcgccaccacttacttccctctcctccctcaccctctctcctactgcgcctggcctctctactgggcctgccaagggtgcgtcctaaccggcgtctgggtcatagcccacgagtgcgtccaccacgcctgcagcgactac

SEQ ID NO: 34920 - DNA, 447 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccccagcaggtggtggccatcgccagcaataatggtggcaagcaggcgctggagacggtgctgtgccaggcccacggcttgaccccccagcaggtggtggccatcgccagcaaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacttcgcctggcctctctactgggcctgccaagggtgcgtcctaaccggcgtctgggtcatagcccacgagtgcggccaccacgccttcagcgactac

SEQ ID NO: 34921 - DNA, 410 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttgcgtagattttcaggtttaacgtcagatgaatatacagtcacagtacccttaacatcagagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 34922 - DNA, 330 bp, Artificial
  Mutation in BnaC.FAD2.a introduced by TALE nuclease pair BnFAD2_T03
caggatccatgggtgcaggtggaagaatgcaagtgtctcctccctccagctcccccgaaaccaaaaccctcaaacgcgtcccctgtagacctcaagaaagcaatcccaccgcactgtttcaaacgctagatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34923 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccattaagccacgatggcggcaagcaggcgctagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcataaccccactactgggcctgccaaggctgcgtcctaacgggcctctgggtcatcgcccacaaatgcggccaccacgccttcagcgactac

SEQ ID NO: 34924 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagctactac

SEQ ID NO: 34925 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaagggtgcgtcctaaccggcgtctgggtcatagcccacgagtgcggccaccacgccttcagcgactac

SEQ ID NO: 34926 - DNA, 357 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtcggtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34927 - DNA, 346 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactacctcaagaaagcaatcccaccgcactgtttcaaacgctcgatccctcgctctttctaatacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34928 - DNA, 354 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34929 - DNA, 349 bp, Artificial
  Mutation in BnaC.FAD2.a introduced by TALE nuclease pair BnFAD2_T03
caggatccatgggtgcaggtggaagaatgcaagtgtatactcactccaagaagtctgaaaccgacaccatcaagcgcgtaccctgcgagacaccgcccttcactgtcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34930 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcagactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 34931 - DNA, 465 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggaccgagatagggttgagtgttgttccagtttggaacaagagtccactattaaagaacgtggactccaacgtcaaagggcgaaaaaccgtctatcagggcgatggttcacgtgagaactcaagaaagcaatcccaccgcactgtttcaaacgctcgatccctcgctctttctcctacctcacctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 34932 - DNA, 349 bp, Artificial
  Mutation in BnaC.FAD2.a introduced by TALE nuclease pair BnFAD2_T03
caggatccatgggtgcaggtggaagaatgcaagtctctactccctccagctcccccggaaccaacaccctcaaacgcgtcccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34933 - DNA, 350 bp, Artificial
  Mutation in BnaC.FAD2.a introduced by TALE nuclease pair BnFAD2_T03
caggatccatgggtgcaggtggaagaatgcaagtgtctcccccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctaccttacctcgcctggcccctctactgggcctgccaaggctgcgtcctaacgggcctctgggtcatcgcccacgaatgcggccaccacgccttcagcgactac

SEQ ID NO: 34934 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccgtcagcgactac

SEQ ID NO: 34935 - DNA, 345 bp, Artificial
  Mutation in BnaC.FAD2.a introduced by TALE nuclease pair BnFAD2_T03
caggatccatgggtgcaggtggaagaatgcaagtgtctcctccctcaaagaagtctgaaaccgacaccatcaagcgcgtaccctgcgagacaccgcccttcactgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34936 - DNA, 403 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttaggtacctcgcgaatgcatctagatccaatgatcatgagcggagaattaaggagaactcaagaaagcaatcccacagcactgtttcaaacgctcgatccctcgctctttctcctacctcatctgggacatcatcatagcctcctgcttctactacgtcgccaccacttacttccctctcctccctcaccctctctcctactgcgcctggcctctctactgggcctgccaagggtgcgtcctaaccggcgtctgggtcatagcccacgagtgcggccaccacgccttcagcgactac

SEQ ID NO: 34937 - DNA, 349 bp, Artificial
  Mutation in BnaC.FAD2.a introduced by TALE nuclease pair BnFAD2_T03
caggatccatgggtgcaggtggaagaatgcaagtctctcctcactccagctcccccgaaaccaaaaccctcaaacgcgtcccctgcgagacaccacccttcactcagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34938 - DNA, 330 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcgaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 34939 - DNA, 285 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccgggtacgcgcttgatgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 34940 - DNA, 336 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 34941 - DNA, 343 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34942 - DNA, 337 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattagacctcaagaaagcaatcccacctcactgcttcaaacgctccatcccacgctccttctcctcttcgacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34943 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34944 - DNA, 462 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgccataaactgccaggcatcaaactaagcagaaggccatccgtctccagcgcctgcttgccaccgccattgccaggcccacggcttgaccccccagcaggtggtggccattagaactcaagaaagcaatcccaccgcactgtttcaaacgctcgatccctcgctctttctcctacctcatctgggacatcatcatagcctcctgcttctactacgtcgccaccacgtacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34945 - DNA, 277 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtacactgcgagacaccgcccttcactgagacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34946 - DNA, 350 bp, Artificial
  Mutation in BnaC.FAD2.a introduced by TALE nuclease pair BnFAD2_T03
caggatccatgggtgcagatggaagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34947 - DNA, 287 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacacagcccttctcctacctcatctgggacatcatcatagcctcctgcttctactacgtcgccaccacttacttccctctcctccctcaccctctctcctacttcgcctggcctctctactgggcctgccaagggtgcgtcccaaccggcgtctgggtcatagcccacgagtgcggccaccacgccttcagcgactac

SEQ ID NO: 34948 - DNA, 380 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcatctagatccaatgatcatgagcggagaattaaggagaactcaagaaagcaatcccaccgcactgtttcaaacgctcgatccctcgctctttctcctacctcatctgggacatcatcatagcctcctgcttctactacgtcgccaccacttacttccctctcccccctcaccctctctcctacttcgcctggcctctctactgggcctgccaagggtgcgtcctaaccggcgtctgggtcatagcccacgagtgcggccaccacgccttcagcgactac

SEQ ID NO: 34949 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 34950 - DNA, 385 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggtcagggtgccggccttgatcatctcgccgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcctctgggtcatcgcccacgaatgcggccaccacgccttcagcgactac

SEQ ID NO: 34951 - DNA, 405 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcaacagccgctggaccgtctccagcgcctgcttgccaccattattgctggcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctcacctacttcgcctggcctctctactgggcctgccaagggtgcgtcctaaccggcgtctgggtcatagcccacgagtgcggccaccacgccttcagcgactac

SEQ ID NO: 34952 - DNA, 347 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcacttacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 34953 - DNA, 342 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttgaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 34954 - DNA, 393 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacacgcctgcttgccgccatcgtggctggcgatggccaccacctgctcctggcacagcagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34955 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34956 - DNA, 327 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcacgtaccctgcgagacatcaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34957 - DNA, 331 bp, Artificial
  Mutation in BnaC.FAD2.a introduced by TALE nuclease pair BnFAD2_T03
caggatccatgggtgcaggtggaagaatgcaagtctctccactctccagctcccccgaaaccaaaaccctcaaacgcgtcccctgcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggcgtcgtcctaacgggcctcggggtcatcgcccaccaatgcgtccaccacgccttcagcgactac

SEQ ID NO: 34958 - DNA, 469 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggtgctgtgccaggcccacggcttgaccccccagcaggtggtggccatcgccagcaatggcggtggcaacagccgctggagccgcagccactggtaacaggattcagggccagccgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34959 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacggatgcggccaccacgccttcagtgactac

SEQ ID NO: 34960 - DNA, 314 bp, Artificial
  Mutation in BnaC.FAD2.a introduced by TALE nuclease pair BnFAD2_T03
caggatccatgggtgcaggtggaataatgcaagtgtctcctccctccaagaagtctgaaaccgacaccatcaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34961 - DNA, 436 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcacggtccagcggctgttgccggtgctgtgccaggcccacggcttgcccccccagcaggtggtggccatcgccagcaatggcggtggcacggagaactcaagaaagcaatcccaccgccctgtttcaaacgctcgatccctcgctctttctcctacctcatctgggacatcatcatagcctcctgcttctactacgtcgccaccacttacttccctctcctccctcaccctctctcctacttcgccgggcctctctactgggcctgccaagggtgcgtcctaacgggcctctgggtcatcgcccacgaatgcggccaccacgccttcagcgactac

SEQ ID NO: 34962 - DNA, 348 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34963 - DNA, 370 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaatggcaagcaggcgctggagacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 34964 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgcgaagggtgcgtcctaaccggcgtctgggtcatagcccacgagtgcggccaccacgccttcagcgactac

SEQ ID NO: 34965 - DNA, 348 bp, Artificial
  Mutation in BnaC.FAD2.a introduced by TALE nuclease pair BnFAD2_T03
caggatccatgggtgcaggtggaagaatgcaagtctctcctcccttcagctcccccggaaccaacaccctcaaacgcgtcccctgcgagacaccacccttcactagacctcaagaaagcaatcccaccgcactgtttcaaacgctcgatccctcgctctttctcctacctcttctgggacatcatcatagcctcctgcttctactacgtccccaccacttacttccctctcctccctcaccctctctcctacttcccctgacccctctactggtcctgccaaggccgcgtcctaacgggcctctgggtcatagcccaccagtgcgtccagcacgccttcagtgactac

SEQ ID NO: 34966 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcaccaccacttacttccctctcctccctcaccctctctcctacttcgcctggcctctctactgggcctgccaagggtgcgtcctaaccggcgtctgtgtcatagcccacgagtgcggccaccacgccttcagcgactac

SEQ ID NO: 34967 - DNA, 356 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 34968 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctatgggtcatagcccacgagtgcggccaccacgccttcagcgactac

SEQ ID NO: 34969 - DNA, 416 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttagttaccggataaggcgcagcggtcgggctcccccacggtgtagatggcgccgtcgggcttcgaaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34970 - DNA, 385 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgaggcttgttgtgaagggattccaacaaaaagtaggcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34971 - DNA, 349 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34972 - DNA, 415 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttggccaccacctgctgaggggtcaagccgtgggcctggcacagcaccggcaacagccgctggaggagacctcaagaaagcaatcccacctcactgcttcaaacgctccatcccacgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34973 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 34974 - DNA, 380 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcatctagatccaatgatcatgagcggagaattaaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 34975 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaaccgcgtaccctgcgagacaccgcccttcactgtaactcaagaaagcaatcccaccgcactgcttcaaacgctcgatccctcgctctttctcctacctcatctgggacatcatcatagcctcctgcttctactacgtcgccacctcttacttccctctcctccctcaccctctctcctccttcgcctggcctctctactgggcccgccaagggtgcgtcctaaccggcgtctgggtcatagcccacgagtgcggccaccacgccttcagcgactac

SEQ ID NO: 34976 - DNA, 335 bp, Artificial
  Mutation in BnaC.FAD2.a introduced by TALE nuclease pair BnFAD2_T03
caggatccatgggtgcaggtggaagaatgcaagtctctcctcactccagctcccccgaaaccaaaaccctcaaacgcgtcccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcccttacctcgcctgacccctctactgggcctgccaaggctgcgtcctaacgggcctctgggtcatcgcccacgaatgcggccaccacgccttcagcgactac

SEQ ID NO: 34977 - DNA, 349 bp, Artificial
  Mutation in BnaC.FAD2.a introduced by TALE nuclease pair BnFAD2_T03
caggatccatgggtgcaggtggaagaatgcaggtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 34978 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 34979 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaaccggcgtctgggtcatagcccacgagtggggccaccacgccttcagcgactac

SEQ ID NO: 34980 - DNA, 342 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccaagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34981 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtacccccagcaggtggtgaccatcgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34982 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgagtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 34983 - DNA, 337 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34984 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctccactgggcctgccaagggtgcgtcctaaccggcgtctgggtcatagcccacgagtgcggccaccacgccttcagcgactac

SEQ ID NO: 34985 - DNA, 354 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34986 - DNA, 348 bp, Artificial
  Mutation in BnaC.FAD2.a introduced by TALE nuclease pair BnFAD2_T03
caggatccatgggtgcaggtggaagaatgcaagtgtcacccccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacggcttcagcgactac

SEQ ID NO: 34987 - DNA, 349 bp, Artificial
  Mutation in BnaC.FAD2.a introduced by TALE nuclease pair BnFAD2_T03
caggatccatgggtgcaggtggaagaatgcaagtatctcctccctccaagaagtctgaaaccgacaccatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34988 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaacaccctcaaacgcgtcccctgcgagacaccacccttcactcagaactcaagaaagcaatcccaccgcactgtttcaaacacacgatccctcgctctttctcctacctcatctgggacatcatcatatcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 34989 - DNA, 333 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacacctcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 34990 - DNA, 350 bp, Artificial
  Mutation in BnaC.FAD2.a introduced by TALE nuclease pair BnFAD2_T03
caggatccatgggtgcaggtggaagaatgcaagtgtctcctccctccaacaagtctgaaaccgacaacatcaagcgcgtaccctgcgagacaccgcccttcactccagaactcaagaaagcaatccccccgcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34991 - DNA, 319 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34992 - DNA, 340 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgttcggctgcggcgagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34993 - DNA, 471 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgggcttgaccccccagcaggtggtggccatcgccagcaataatggtggcaagcaggcgctggagacggtccagcggctgttgccggtgctgtgccaggcccacggcttgaccccccagccgagaactcaagaaagcaatcccaccgcactgtttcaaacgctcgatccctcgctctttctcctacctcacctgggaccgcatcatagcctcctgcttctactacgtcgccaccacttacttccctctcctccctcaccctctctcctacttcgcctggcctctctactgggcctgccaagggtgcgtcctaaccggcctctgggtcatagcccacgagtgcggccaccacgccttcagcgactac

SEQ ID NO: 34994 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 34995 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34996 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 34997 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaactggcctctgggtcatcgcccacgaatgcggccaccacgccttcagcgactac

SEQ ID NO: 34998 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaagaactcaagaaagcaatcccaccgcactgtttcaaacgctcgatccatcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 34999 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccacactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35000 - DNA, 314 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgataccatcaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35001 - DNA, 343 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcaactcaagaaagcaatcccaccgcactgcttcaaacgctcgatccctcgctctttctcctacctcatctgggacatcatcatagcctcctgcttctactacgtcgccaccacttacttccctctcctccctcaccctctctcctacttcgcctgacccctctactgggcctgccaagggtgcgtcctaaccggcgtctgggtcatagcccacgagtgcggccaccacgccttcagcgactac

SEQ ID NO: 35002 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggcggcgtcctaacgggcctctgggtcatcgcccacgaatgcggccaccacgccttcagcgactac

SEQ ID NO: 35003 - DNA, 350 bp, Artificial
  Mutation in BnaC.FAD2.a introduced by TALE nuclease pair BnFAD2_T03
caggatccatgggtgcaggtgaaagaatgcaagtgtcaaccccctccaaaaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctacttcgcctagcctctctactgggcctgccaagggtgcggcttgatcggcgtctgggtcatagcttacatgtgcgtccaccacgcctagagcgactac

SEQ ID NO: 35004 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaatggtgcgtcctaaccggcgtctgggtcatagcccacgagtgcggccaccacgccttcagcgactac

SEQ ID NO: 35005 - DNA, 343 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35006 - DNA, 349 bp, Artificial
  Mutation in BnaC.FAD2.a introduced by TALE nuclease pair BnFAD2_T03
caaggatccatgggtgcagggggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35007 - DNA, 350 bp, Artificial
  Mutation in BnaC.FAD2.a introduced by TALE nuclease pair BnFAD2_T03
caggatccatgggtgcaggtggaagaatgcaagtgtctcctctcttcaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35008 - DNA, 325 bp, Artificial
  Mutation in BnaC.FAD2.a introduced by TALE nuclease pair BnFAD2_T03
cagtatccatgggtgcaggtggaagaatgcaagtgtctcctccctccaagaagtctgaaaccgacaccatcaagcgcgtatagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35009 - DNA, 346 bp, Artificial
  Mutation in BnaC.FAD2.a introduced by TALE nuclease pair BnFAD2_T03
caggatccatgggtgcaggtggaagaatgcaagtgtctcctccctccagctcccccgaaaccaaaaccctcaaacgcgtcccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcacgactac

SEQ ID NO: 35010 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccattaagccacgatggcggcaagcaggcgctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 35011 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 35012 - DNA, 355 bp, Artificial
  Mutation in BnaC.FAD2.a introduced by TALE nuclease pair BnFAD2_T03
caggatccatgggtgcaggtggaagaatgcaagtgtcccctccctccaagaagtctgaaaccgacaccatcaagcgcgtaccctgcgagacaccgcccttcactgtcgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35013 - DNA, 434 bp, Artificial
  Mutation in BnaC.FAD2.a introduced by TALE nuclease pair BnFAD2_T03
caggatccatgggtgcaggtggaagaatgcaagtgtctactccctcaaagaagtctgaaaccgacaccatcaagcgcgtaccctgcgagacaccgcccttcactgtcccagcaggtggtggccatcgccagcaatggcggtggcaagcaggcgctggagacggtccagcggctgatgccggggctgtgccagaactcaagaaagcaatcccaccgcactgtttcaaacgcgcgatccctcgcgctttctcctaccccagctgggacatcatcatagcctcctgcttctactacgtcgccaccacttacttccctctcctccctcaccctctcccttacctcgcctggcccctctactgggcctgtcaaggctgcggcctaacgggcctctgggtcatcgcccacgaatgcggccaccacgccttcagcgactac

SEQ ID NO: 35014 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgcccgatccctcgccctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35015 - DNA, 338 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaagaaagcaatcccaccgcactgtttcaaacgctcgatccctcgctctttctcctacctcatctgggacatcatcatagcctcctgcttctactacgtcaccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35016 - DNA, 385 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcgggtcagggtgccggccttgatcatctcgccgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35017 - DNA, 333 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 35018 - DNA, 350 bp, Artificial
  Mutation in BnaC.FAD2.a introduced by TALE nuclease pair BnFAD2_T03
caggatccatgggtgcaggtggaagaatgcaagtgtcaccttcctccaagaagtctgaaaccgacaccatcaagcgcgtaccctgtgagacaccgcccttcactgtagaactcaagaaagcaatcccaccgcactgtttcaaacgatcgatccctcgctctttctcctacctcatctgggacatcatcatagcctcctgcttctactacgtcgccaccacgtacttccctctcctccctcaccctctctcctacttcgcctagcccctctactgggcctgccaaggctgcggcctaacgcgcctctgggtcatcgcccacgaatgcggccaccacgccttcagcgactac

SEQ ID NO: 35019 - DNA, 325 bp, Artificial
  Mutation in BnaC.FAD2.a introduced by TALE nuclease pair BnFAD2_T03
caggatccatgggtgcaggtggaagaatgcaagtgtctcctcactccaagaagtctgaaaccgacaccatcaagcgcgtatagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggcgtcgtcctaacgggcctctgggtcatcgcccacgaatgcgtccaccacgcctgcagcgactac

SEQ ID NO: 35020 - DNA, 350 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgtagaactcaagaaagcaatcccaccgcactgtttcaaacgctcgctccctcgctcttcctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccgcgccttcagcgactac

SEQ ID NO: 35021 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 35022 - DNA, 417 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagatcggcgatatcgatgctgtccatgtgctgtctctcgaacttggcagcggcagtctccttatcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35023 - DNA, 350 bp, Artificial
  Mutation in BnaC.FAD2.a introduced by TALE nuclease pair BnFAD2_T03
caggatccatgggtgcagggtgaagaatgcaagtgtcccctccctccaagaagtctgaaaccgacaccatcaagcgcgtaccctgcgagacaccgcccttcactgtagaactcaagaaagcaatcccaccgcactgtttcacacgctcgatccctcgctctttctcctacctcatctgggacatcatcatagcctcctgcttctactacgtcgccaccacttacttccctctcctccctcaccctctctcctgcttcgcctggcctctctactgggcctgccaagggtgcgtcctaaccggcgtctgggtcatagcccacgagtgcggccaccacgccttcagcgactac

SEQ ID NO: 35024 - DNA, 343 bp, Artificial
  Mutation in BnaC.FAD2.a introduced by TALE nuclease pair BnFAD2_T03
caggatccatgggtgcaggtggaagaatgcaagtgtctcctccgtccaagaagcctgaacccgacaccatcaagcgcgtaccctgcgagacaccgcccttcactgttagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtccgagccggagtctgggtcatagcccacgattgcggccaccacgccatcagcgactac

SEQ ID NO: 35025 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgccctgcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35026 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35027 - DNA, 345 bp, Artificial
  Mutation in BnaC.FAD2.a introduced by TALE nuclease pair BnFAD2_T03
caggatccatgggtgcaggtgcaagaatgcaagtctctcctccatccaagaagtctgaaaccgacaccatcaagcgcgtaccctgcgagacaccgcccttcactgctcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35028 - DNA, 348 bp, Artificial
  Mutation in BnaC.FAD2.a introduced by TALE nuclease pair BnFAD2_T03
caggatccatgggtgcaggtggaagaatgcaagtgtcacctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 35029 - DNA, 334 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 35030 - DNA, 334 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgacactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcggcctaacgggcctctgggtcatagcccacgagtgcgtccaccacgccttcagcgactac

SEQ ID NO: 35031 - DNA, 347 bp, Artificial
  Mutation in BnaC.FAD2.a introduced by TALE nuclease pair BnFAD2_T03
caggatccatgggtgcaggtggaagaatgcaagtctctactccctccagctcccccgaaaccaaaaccctcaaacgcgtccactgcgagacaccacccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35032 - DNA, 348 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactcc

SEQ ID NO: 35033 - DNA, 359 bp, Artificial
  Mutation in BnaC.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcacgtctccagcgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccactagtgcggccaccacgccttcagcgactac

SEQ ID NO: 35034 - DNA, 331 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35035 - DNA, 344 bp, Artificial
  Mutation in BnaC.FAD2.a introduced by TALE nuclease pair BnFAD2_T03
caggatccatgggtgcaggtggaagaatgcaagtgtctcctcctccaagaagtctgaaaccgacaccatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35036 - DNA, 349 bp, Artificial
  Mutation in BnaC.FAD2.a introduced by TALE nuclease pair BnFAD2_T03
caggatccatgggtgcaggggaaagaatgcaagtgtatcatccctccaagaagtctgaagccgacaccatcaagcgcgtaccctgcgagacaccgcccttcactgagaactcaagaaagcaatcccaccgcactgtttcaaacgctcgatccctcgctctttctcctaccccatctgggacatcatcatagccgcctgcttctactacgtcgccacctcgtacttccctctcctccctcaccctctctcctacttcgcctggcctctctactgggcctgccaagggtgcgtcctaaccggcgtctgggtcatagcccacgagtgcggccaccacgccatgagcgactac

SEQ ID NO: 35037 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 35038 - DNA, 382 bp, Artificial
  Mutation in BnaC.FAD2.a introduced by TALE nuclease pair BnFAD2_T03
caggatccatgggtgcaggtggaagaatgcaagtctcacctccctacagctcccccggaaccaacaccctcaaacgcgtcccctgcgagacaacaccatcaacatcgtggctggcgatggccaccacctgtgccaggcccacctcaagaaagcaatcccaccgcactgtttcaaacgctcgatccctcgctctttctcctacctcatctgggacatcatcatagcctcctgcttctactacgtcgccaccacttacttccctctcctccctcaccctcgctcctacttcgcctggcctctctactgggcctgccaagggtgcgtcctaaccggcgtctgggtcatagcccacgagtgcggccaccacgccttcagcgactac

SEQ ID NO: 35039 - DNA, 342 bp, Artificial
  Mutation in BnaC.FAD2.a introduced by TALE nuclease pair BnFAD2_T03
caggatccatgggtgcaggtggaagaatgcaagtgtctcctacctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35040 - DNA, 319 bp, Artificial
  Mutation in BnaC.FAD2.a introduced by TALE nuclease pair BnFAD2_T03
caggatccatgggtgcaggtggaagaatgcaagtgtctcctccctacaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 35041 - DNA, 419 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtccgactgagcctttcgttttatttgttgtttgtcggtgaacgctctcctgagtaggacaaatccgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35042 - DNA, 349 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 35043 - DNA, 349 bp, Artificial
  Mutation in BnaC.FAD2.a introduced by TALE nuclease pair BnFAD2_T03
caggatccatgggtgcaggtggaagaatgcaagtgtctcctccaaccaagaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctggtgcatagcccacgagtgcggccaccacgccttcagcgactac

SEQ ID NO: 35044 - DNA, 343 bp, Artificial
  Mutation in BnaC.FAD2.a introduced by TALE nuclease pair BnFAD2_T03
caggatccatgggtgcaggtggaagaatgcaagtctctcctccctccagctcccccgaaaccgacaccatcaagcgcgtaccctgcgagacaccgcccttcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 35045 - DNA, 351 bp, Artificial
  Mutation in BnaC.FAD2.a introduced by TALE nuclease pair BnFAD2_T03
caggatccatgggtgcaggtggaagaatgcaagtgtctccctcctccaagaagtctgaaaccgacaccatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35046 - DNA, 348 bp, Artificial
  Mutation in BnaC.FAD2.a introduced by TALE nuclease pair BnFAD2_T03
caggatccatgggtgcaggtggaagaatgcaagtgtctcctacctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagctactac

SEQ ID NO: 35047 - DNA, 442 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaccgtccagcggctgatgcctgtgctgtgccaggcccacggcctgaccccggagcaggaggcggccatctcccgccaccatggcggcaaacaggcgccggagggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35048 - DNA, 346 bp, Artificial
  Mutation in BnaC.FAD2.a introduced by TALE nuclease pair BnFAD2_T03
caggatccatgggtgcaggtggaagaatgcaagtgactcctcccaccaagaagtctgaaaccgacaccatcaagcgcgtaccctgcgagacaccgcccttcactaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35049 - DNA, 308 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatagcccacgagtgcggccaccacgccttcagcgactac

SEQ ID NO: 35050 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatccagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35051 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtgctagccggcgtctgggtcatagcccgcgagtgcggcgaccgcgccgtcagcgactac

SEQ ID NO: 35052 - DNA, 347 bp, Artificial
  Mutation in BnaC.FAD2.a introduced by TALE nuclease pair BnFAD2_T03
caggatccatgggtgcaggtggaagaatgcaagtgtctcctccatccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcagagcccacgagtgctgccaccacgccgtcatcgactac

SEQ ID NO: 35053 - DNA, 400 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactctcggcaccggcaacagccgctggaccgtctccagcgcctgcttgccaccagagacctcaagaaagcaatcccaccgcactgtttcaaacgctcgatccctcgctctttctcctacctcatctgggacatcatcatagcctcctgcttctactacgccgccaccacttacttccctctcctccctcaccctctctcctacgtcgcctggcctctctactgggcctgccaagggtgcgtcctaaccggcgtctgggtcatagcccacgagtgcggccaccacgccttcagcgactac

SEQ ID NO: 35054 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactctcctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35055 - DNA, 327 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttccccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35056 - DNA, 327 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttccccaccgcactgtttcaaacgctcgatccctcgctctttctcctacctcatttgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 35057 - DNA, 323 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagaaagcaatcccacctcactgcttcaaacactcgatccctccccctttctcctacctcatctgggacctcatcatagcctcctgcttctcctacgtcgccacctcttacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 35058 - DNA, 332 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccatcagcgactac

SEQ ID NO: 35059 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactctcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35060 - DNA, 333 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaacaaagcaatcccaccgcactgtttcaaacgctccatcccaccccccttctcctcttcgacatcatcatctcctcctcggctcctccatctaccacttctccacagcctccttccctctcccttacctcgcctggcccctctactgggcctgccaaggctgcgtcctaacgggcctctgggtcatagcccacgagtgcggccaccacgccttcagcgactac

SEQ ID NO: 35061 - DNA, 346 bp, Artificial
  Mutation in BnaC.FAD2.a introduced by TALE nuclease pair BnFAD2_T03
caggatccatgggtgcaggtggaagaatgcaagtgtctcatccctacaagaagtctgaaaccgacaccatcaagcgcgtaccctgcgagacaccacccttcaagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35062 - DNA, 335 bp, Artificial
  Mutation in BnaC.FAD2.a introduced by TALE nuclease pair BnFAD2_T03
caggatccatgggtgcaggtggaagaatgcaagtctctcctccatccagctcccccggaaccaacaccctcaaacgcgtcccctgcgagcgagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35063 - DNA, 347 bp, Artificial
  Mutation in BnaC.FAD2.a introduced by TALE nuclease pair BnFAD2_T03
caggatccatgggtgcaggtggaagaatgcaagtgcctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttccgcgactac

SEQ ID NO: 35064 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccctcaagcgcgtaccctgcgagacaccgcccttcactgagaattcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaggggtgcgtcctaaccggcgtctgggtcatagcccacgagtgcggccaccacgccttcagcgactac

SEQ ID NO: 35065 - DNA, 348 bp, Artificial
  Mutation in BnaC.FAD2.a introduced by TALE nuclease pair BnFAD2_T03
caggatccatgggtgcaggtggaagaatgcaagtgtctcctccatccaagaaggctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccacctcttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35066 - DNA, 349 bp, Artificial
  Mutation in BnaC.FAD2.a introduced by TALE nuclease pair BnFAD2_T03
caggatccatgggtgcaggtggaagaatgcaagtgactcaaccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccatcagcgactac

SEQ ID NO: 35067 - DNA, 416 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgttagttaccggataaggcgcagcggtcgggctgaacgggggtgtagatggcgccgtcgggcttcgaaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35068 - DNA, 347 bp, Artificial
  Mutation in BnaC.FAD2.a introduced by TALE nuclease pair BnFAD2_T03
caggatccatgggtgcaggtggaagaatgcaagtgtctcctcccttcaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactgc

SEQ ID NO: 35069 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcctggcctctctactgggcctgccaagggtgcgtcctaaccggcgtctgggtcatagcccacgagtgcggccaccacgccttcagcgactac

SEQ ID NO: 35070 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgaaactcaagaaagcaatcccaccgcactgtttcaaacgctcgatcccccgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35071 - DNA, 351 bp, Artificial
  Mutation in BnaC.FAD2.a introduced by TALE nuclease pair BnFAD2_T03
caggatccatgggtgcagggggaagaatgcaagtgtctcctccctccaagaagtctgaaaccgacaccatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35072 - DNA, 348 bp, Artificial
  Mutation in BnaC.FAD2.a introduced by TALE nuclease pair BnFAD2_T03
caggatccatgggtgcaggtggaagaatgcaagtctcccctccctccagctcccccgaacccaaaaccatcaaacgcgtcccctgcgagccaccgcccttcactagaactcaagaaagcaatcccaccgcactgtttcaaacgctcgatccctcgctctttctcctacctcatctgggacatcatcatagcctcctgcttctactacggcgccaccacttccttccctctcctccctcaccctctctcctgcttcgcctggcctctctactgggcctgccaagggtgcgtcctaaccggcgtctgggtcatagcccacgagtgcggccaccacgccttcagcgactac

SEQ ID NO: 35073 - DNA, 350 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccatctcctccctcaccctctctcctacttcgcctggcctctctactgggcctgccaagggtgcgtcctaaccggcgtctgggtcatagcccacgagtgcggccaccacgccttcagcgactac

SEQ ID NO: 35074 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggccgctctacggggcctgccaagggtgcgtcctaaccggcgtctgggtcatagcccacgagtgcggccaccacgccttcagcactac

SEQ ID NO: 35075 - DNA, 339 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35076 - DNA, 305 bp, Artificial
  Mutation in BnaC.FAD2.a introduced by TALE nuclease pair BnFAD2_T03
caggatccatgggtgcaggcgcaagaatgcaagtggcacctcccaccaagaagtctgaaaccgaactcaagaaagcaatcccaccgcactgtttcaaacgctcgatccctcgctctttctcctacctcatctgggacatcatcatagcctcctgcttctactacgtcgccacaacttacttccctctcctccctcaccctctctcctacttcgcctggcctctctactgggcctgcctagggtgcgtcctaaccggcgtctgggtcacttcccacgtgtgcggccaccgcgccatcagcgactac

SEQ ID NO: 35077 - DNA, 391 bp, Artificial
  Mutation in BnaC.FAD2.a introduced by TALE nuclease pair BnFAD2_T03
caggatccatgggtgcaggtagaagaatgcaagtgtcacttccctccaagaagtctgaaaccgacaccatcaaccgcgtaccctgagagacaccgcccttcactgtacggtccagcggctgttgccggtgctgtgccaggcccacggagaactcaagaaagcaatcccaccgcactgtttcaaacgctcgatccctcgctctttctcctatctcatctgggacatcatcatagcctcctgcttctactacgtcgccaccacttactaccccctcctccctcaccctctctcctacttcgccgggcctctctactgcgcctgccaagggtgcgtcctaacgggcctctgggtcatcgccctcgaatgcggccaccgcgccttcatcgactac

SEQ ID NO: 35078 - DNA, 305 bp, Artificial
  Mutation in BnaC.FAD2.a introduced by TALE nuclease pair BnFAD2_T03
caggatccatgggtgcaggtgtaagaatgcaagtgtctcctccctccaagaagtctgaaaccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35079 - DNA, 342 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaaccggcgtctgggtcagagcccacgagtgcggccaccacgccttcagcgactac

SEQ ID NO: 35080 - DNA, 334 bp, Artificial
  Mutation in BnaC.FAD2.a introduced by TALE nuclease pair BnFAD2_T03
caggatccatgggtgcaggtggaagaatgcaagtgtatcatccctccaagaagtctgaaaccgacaccatcaagcgcgtaccctgcgagacaccgcccttcactgagaactcaagaaagcaatcccaccgcactgttacaaacgctccatccctcgctccttctcctacctcctcttcgacatcctcgtctcctcctccctctaccacctctccacagcctacttccctctcccttacctcgcctgacccctctactgggcctgccaagggtgcgtcctaaccggcgtctaggtcatagccctcgagtgcggccaccacgccgtcagcgactgc

SEQ ID NO: 35081 - DNA, 349 bp, Artificial
  Mutation in BnaC.FAD2.a introduced by TALE nuclease pair BnFAD2_T03
caggatccatgggtgcaggtggaagaatgcaagtgtctcctccatccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctggggcatagcccacgagtgcggccaccacgccttcagcgactac

SEQ ID NO: 35082 - DNA, 383 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacggtccagcggctgttgccggtgctgtgccaggcccacggcttgaccccggagcaggtggtggccagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatagcccacgagtgcggccaccacgccttcagcgactac

SEQ ID NO: 35083 - DNA, 350 bp, Artificial
  Mutation in BnaC.FAD2.a introduced by TALE nuclease pair BnFAD2_T03
catgatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 35084 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagccaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctggggcatagcccacgagtgcggccaccacgccttcagcgactac

SEQ ID NO: 35085 - DNA, 343 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttggaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35086 - DNA, 333 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35087 - DNA, 412 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgactgggcctttcgttttatctgttgtttgtcggtgaacgctctcctgagtaggacaaatccggagaactcaagaaagcaatcccaccgcactgtttcaaacgctcgatccctcgctctttctcctacctcatctgggacatcatcatagcctcctgcttctactacggcgccacctcttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35088 - DNA, 350 bp, Artificial
  Mutation in BnaC.FAD2.a introduced by TALE nuclease pair BnFAD2_T03
caggatccatgggtgcaggtggaagaatgcaagtgtctcctccatccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35089 - DNA, 349 bp, Artificial
  Mutation in BnaC.FAD2.a introduced by TALE nuclease pair BnFAD2_T03
caggatccatgggtgcaggtggaagaatgcaagtgtcacctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctggggcatagcccacgagtgcggccaccacgccttcagcgactac

SEQ ID NO: 35090 - DNA, 428 bp, Artificial
  Mutation in BnaC.FAD2.a introduced by TALE nuclease pair BnFAD2_T03
caggatccatgggtgcaggtggaagaatgcaagtctctcatccctccagctcccccggaaccaacaccctcaaacgcgtcccctgcgagacaccaccattcactctcgggccgccattgctggagatggccaccacctgctgaggggtcaagccgtgggcctggcacagcaccggcaacagccgagacctcaagaaagcaatcccaccgcactgtttcaaacgctcgatccctcgctctttctcctacctcatctgggacatcatcatagcctcctgcttctactacgtcgccaccacgtacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35091 - DNA, 348 bp, Artificial
  Mutation in BnaC.FAD2.a introduced by TALE nuclease pair BnFAD2_T03
caggatccatgggtgcaggtgaaagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtccgaaccggcgtctgggtcatagcccacgagtgcggccaccacgccatcagcgactac

SEQ ID NO: 35092 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 35093 - DNA, 347 bp, Artificial
  Mutation in BnaC.FAD2.a introduced by TALE nuclease pair BnFAD2_T03
caggatccatgggtgcagggggaagaatgcaagtgtctcctccatccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcagagcccacgagtgctgctaccacgccttcagcgactac

SEQ ID NO: 35094 - DNA, 325 bp, Artificial
  Mutation in BnaC.FAD2.a introduced by TALE nuclease pair BnFAD2_T03
caggatccatgggtgcaggtggaagaatgcaagtgtcacctccctccaagaagtctgaaaccgacaccatcaagcgcgtatagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35095 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35096 - DNA, 350 bp, Artificial
  Mutation in BnaC.FAD2.a introduced by TALE nuclease pair BnFAD2_T03
caggatccatgggtgcaggtggaagaatgcaagtgtcacctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgctgccaccacgccttcagcgactac

SEQ ID NO: 35097 - DNA, 280 bp, Artificial
  Mutation in BnaC.FAD2.a introduced by TALE nuclease pair BnFAD2_T03
caggatccatgggtgcaggtagaagaatgcaagtgtctcctccctccaagaagtctgaaaccgacaccatcaagcgcgtaccctgcgagacaccgcccttcactgtcgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35098 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcggggtcatagcccacgagtgcggccaccacgccttcagcgactac

SEQ ID NO: 35099 - DNA, 348 bp, Artificial
  Mutation in BnaC.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35100 - DNA, 351 bp, Artificial
  Mutation in BnaC.FAD2.a introduced by TALE nuclease pair BnFAD2_T03
caggatccatgggtgcaggtggaagaatgcaagtctctcctccatccagctcccccgaaaccaaaaccctcaaacgcgtcccctgcgagacaccacccttcactcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 35101 - DNA, 375 bp, Artificial
  Mutation in BnaC.FAD2.a introduced by TALE nuclease pair BnFAD2_T03
cagtgtgtataagagacagcaggatccatgggtgcaggtggaagaatgcaagtgtctcctccctccaagaagtctgaaaccgacaccatcaagcgcgtaccctgcgagacaccgcccttcactgtcgacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35102 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 35103 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 35104 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35105 - DNA, 349 bp, Artificial
  Mutation in BnaC.FAD2.a introduced by TALE nuclease pair BnFAD2_T03
caggatccatgggtgcaggccgaagaatgcaagtgtctcctccctacaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactcc

SEQ ID NO: 35106 - DNA, 345 bp, Artificial
  Mutation in BnaC.FAD2.a introduced by TALE nuclease pair BnFAD2_T03
caggatccatgggtgcaggtccaagaatgcaagtgtctcctccctccagctcccccgaaaccaaaaccctcaaacgcgtcccctgcgagacaccacccttcactgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 35107 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtaccctgcgagacaccgcccttcactgtagaactcaagaaagcaatcccaccgcactgtttcaaacgctcgatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35108 - DNA, 350 bp, Artificial
  Mutation in BnaC.FAD2.a introduced by TALE nuclease pair BnFAD2_T03
caggatccatgggtgcaggcggaagaatgcaagtgtccccttcctccaagaagtctgaaaccgacaccatcaagcgcgtaccctgcgagacaccgcccttcactgtagaactcaagaaagcaatcccaccgcactgtttcaaacgctcgatccctagctctttctcctacctcatctgggacatcatcatagcctcctgcttctactacgtcgccaccacttacttccctctcctccctcaccctctctcctacgtcacctggcctcactactgggcctgccaagggtgcgtccgaaccggcgtctgggtcatagcccacgagtgcggccaccacgccttcagcgactac

SEQ ID NO: 35109 - DNA, 357 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggtcggagacctcaagaaagcaatcccacctcactgcttcaaacgctcgatccatcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35110 - DNA, 349 bp, Artificial
  Mutation in BnaC.FAD2.a introduced by TALE nuclease pair BnFAD2_T03
caggatccatgggtgcaggtggaacaatgcaagtgtctcctccatccaagaagtctgaaaccgacaccatcaagcgcgtaccctgcgagacaccgcccttcactgtatcatcaagaaagcaatcccaccgcactgtttcaaacgctcgatccctcgctctttctcctacctcatctgggacatcatcatagcctcctggttctactacgtcgccaccacgtacttccctctcctcactcaccctctctcctacttcgcctggcctctctactgggcctgccaagggtgcgtcctaaccggcgtctgggtcatagcccacgagtgcggccaccacgccttcagcgactac

SEQ ID NO: 35111 - DNA, 308 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctggttcatagcccacgagtgcggccaccacgccttcagcgactac

SEQ ID NO: 35112 - DNA, 356 bp, Artificial
  Mutation in BnaC.FAD2.a introduced by TALE nuclease pair BnFAD2_T03
caggatccatgggtgcaggtggaagaatgcaagtgtctcctccctccaagaactctgaaaccgacaacatcaagcgcgtaccctgcgagacaccgcccttcacttcttccaccgtactcaagaaagcaatcccacctcactgtttcagacgcccgatccctcgctcgttctcctacctcatctgcgacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35113 - DNA, 350 bp, Artificial
  Mutation in BnaC.FAD2.a introduced by TALE nuclease pair BnFAD2_T03
caggatccatgggtgcaggtggaagaatgcaagtgtctcctcctcccaagaagtctgaaaccgacaccatcaaccgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcagagcccaccagtgcggccaccacgccttcgtcgactac

SEQ ID NO: 35114 - DNA, 336 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctccatcccacgctccttctcctcttcgccatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35115 - DNA, 347 bp, Artificial
  Mutation in BnaC.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactgttaccgcgaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgctgccaccacgccttcagcgactac

SEQ ID NO: 35116 - DNA, 350 bp, Artificial
  Mutation in BnaC.FAD2.a introduced by TALE nuclease pair BnFAD2_T03
caggatccatgggtgcagggggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctggcacatcatcatagcctcctgcttctactacgtcgccaccacttacttccctctcctccctcaccctctctcctacttcgcctggcctctctactgggcctgccaagggtgcttcctaaccggcgtctgggtcacagcccacgagtgcggccaccacgccatcagcgactac

SEQ ID NO: 35117 - DNA, 345 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtacaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35118 - DNA, 347 bp, Artificial
  Mutation in BnaC.FAD2.a introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctcctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctttctactgggcctgccaagggtgcgtcctaaccagcgtctgggtcatagcccacgagtgcggccaccacgccttcagcgactac

SEQ ID NO: 35119 - DNA, 428 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcggtgctgtgccaggcccacggcttgaccccccagcaggtggtggccatcgccagcaataatggcggcaagcaggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35120 - DNA, 346 bp, Artificial
  Mutation in BnaC.FAD2.a introduced by TALE nuclease pair BnFAD2_T03
caggatccatgggtgcaggtggaagaattcaagtctctcccccctacagcccccccggaaccaacaccctcaaacgcgtcccctgcgagacaccaccattcaagacctcaagaaagcaatcccacctcactgcttcaaactctccatccctcgctctttctcctacctcatctgggacatcatcatagcctcctgcttctactacgtcgccaccacttacttccctctcctccctcaccctctctcctacttcgcctggcctctctactgggcctgccaagggtgcgtccgaaccggcgtcgggctcatagcccgcgagtgcggcctccacgccttcagcaactac

SEQ ID NO: 35121 - DNA, 308 bp, Artificial
  Mutation in BnaC.FAD2.a introduced by TALE nuclease pair BnFAD2_T03
caggatccatgggtgcaggtggaagaatgcaattgtctcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 35122 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcgaccaccacgccttcagcgactac

SEQ ID NO: 35123 - DNA, 405 bp, Artificial
  Mutation in BnaC.FAD2.a introduced by TALE nuclease pair BnFAD2_T03
caggatccatgggtgcaggtggaagaatgcaagtgtctcctccctccagctcccccgaaaccaaaaccctcaaacgcgtcccctgcgagacaccgcccttcactgtcggcaacagccgctggaccgtctccagcgcctgcttgccaccattattgctggcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 35124 - DNA, 341 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggtctctctactgggcctgccaagggtgcgtcctaaccggcgtctgggtcatagcccacgagtgcggccaccacgccttcagcgactac

SEQ ID NO: 35125 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctcttggtcatcgcccacgaatgcggccaccacgccttcagcgactac

SEQ ID NO: 35126 - DNA, 382 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgatagttgagtcgatacttcggcgatcaccgctgaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaagggtgcgtcctaaccggcgtctgggtcatagcccacgagtgcggccaccacgccttcagcgactac

SEQ ID NO: 35127 - DNA, 316 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35128 - DNA, 316 bp, Artificial
  Mutation in BnaC.FAD2.a introduced by TALE nuclease pair BnFAD2_T03
caggatccatgggtgcaggtcgaagaatgcaagtgtcccctccccccaagaagtctgaacccgacaccatcaagaactcaagacagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtccgaaccggcgtctgggtcatagcccacgagtgcggccaccacgccttcagcgactac

SEQ ID NO: 35129 - DNA, 354 bp, Artificial
  Mutation in BnaC.FAD2.a introduced by TALE nuclease pair BnFAD2_T03
caggatccatgggtgcagggggaagaatgcaagtgtctcctccttccaaaaagtctgaaaccgacacaatcaagcgcgtaccctgcgagacaccgcccttcactgattgtagaactcaagaaagcaatcccaccgcactgtttcaaacgctcgatccctcgctctttctcctacctcatctgggacatcatcatagcctcctgcttctactacgtcgccaccacttacttccctctcctccctctccctctctcctacgtcgcctggcctctctactgggcctgccaagggtgcgtcctaaccggcgtctgggtcagagcccacgagtgcggccaccacgccttcagcgactac

SEQ ID NO: 35130 - DNA, 349 bp, Artificial
  Mutation in BnaC.FAD2.a introduced by TALE nuclease pair BnFAD2_T03
caggatccatgggtgcaggtggaagaatgcaagtgtctcctacatccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35131 - DNA, 350 bp, Artificial
  Mutation in BnaC.FAD2.a introduced by TALE nuclease pair BnFAD2_T03
caggatccatgggtgcaggtggaagaatgcaagtgtctcctccatccaagaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactc

SEQ ID NO: 35132 - DNA, 423 bp, Artificial
  Mutation in BnaC.FAD2.a introduced by TALE nuclease pair BnFAD2_T03
caggatccatgggtgcagggagaagaatgcaagtgtctcttccctccaagaagtctgaaaccgacaccatcaagcgcgtaccctgcgcgacaccgcccttcactgtcggagatggccaccacctgctccggggtcaagccgtggggctggcacagcaccggcaacaggcgctggagactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcagagcccacgagtgcggccaccgcgccttcagcgactac

SEQ ID NO: 35133 - DNA, 345 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 35134 - DNA, 350 bp, Artificial
  Mutation in BnaC.FAD2.a introduced by TALE nuclease pair BnFAD2_T03
caggatccatgggtgcaggtggaagaattcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 35135 - DNA, 344 bp, Artificial
  Mutation in BnaC.FAD2.a introduced by TALE nuclease pair BnFAD2_T03
caggatccatgggtgcaggtggaagaatgcaagtgtctcctccatccaagaagtctgaaaccgacaccatcaagcgcgtaccctgcgagacaccgcccttcacactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35136 - DNA, 347 bp, Artificial
  Mutation in BnaC.FAD2.a introduced by TALE nuclease pair BnFAD2_T03
caggatccatgggtgcaggtgaaagaatgcaagtctcacactcctccagctcccccggaaccaacaccctcaaacgcgtcccctgcgagacaccaccattcacagacctcaagaaagcaatcccacctcactgcttcaaacgctcgatccctcgctctttctcctacctcacctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccatcagcgactac

SEQ ID NO: 35137 - DNA, 368 bp, Artificial
  Mutation in BnaC.FAD2.a introduced by TALE nuclease pair BnFAD2_T03
caggatccatgggtgcaggtggaagaatgcaagtgtctcctgcctccaagaagtctgaaaccgacaccatcaagcgcgtaccctgcgagacaccgcccttcactgtagcaatggcggtggctggagaactcaagaaagcaatcccaccgcactgtttcaaacgctcgatccctcgctctttctcctacctcatctgggacatcatcatagcctcctgcttctactacgtcgccaccacttacttccctctcctccctctccctctctcctacttcgcctggcctctctactgggcctgccaagggtgcgtcctaaccggcgtctgggtcatagcccacgagtgcggccaccacgccttcagcgactac

SEQ ID NO: 35138 - DNA, 351 bp, Artificial
  Mutation in BnaC.FAD2.a introduced by TALE nuclease pair BnFAD2_T03
caggatccatgggtgcaggtggaagaatgcaagtgtctcatccctccaagaagtctgaaaccgacaccatcaagcgcgtaccctgcgagacaccgcccttcactgcaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35139 - DNA, 348 bp, Artificial
  Mutation in BnaC.FAD2.a introduced by TALE nuclease pair BnFAD2_T03
caggatccatgggtgcaggtgaaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35140 - DNA, 388 bp, Artificial
  Mutation in BnaC.FAD2.a introduced by TALE nuclease pair BnFAD2_T03
caggatccatgggtgcaggtgaaagaatgcaagtgtcacctccctccaagaagtctgaaaccgacaccatcaagcgcgtaccctgcgagacaccgcccttcactcacccgtcagtgcattgcgccatgcatgcactgcctccagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35141 - DNA, 349 bp, Artificial
  Mutation in BnaC.FAD2.a introduced by TALE nuclease pair BnFAD2_T03
caggatccatgggtgcaggtggaagaatgcaagtgtctcctccatccaagaagtctgaaaccgacaccatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcgaccaccacgccttcagcgactac

SEQ ID NO: 35142 - DNA, 327 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaaagcaatcccaccgcactgtttcaaacgctcgatccctcgctctttctcctacctcatctgggacatcatcatagcctcctgcttctactacgtcgccacagcctacttccctctcccttacctcgcctgacccctctactgggcctgccaaggctgcgtcctaacgggcctctgggtcatagcccacgagtgcggccaccacgccttcagcgactac

SEQ ID NO: 35143 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccatcagcgactac

SEQ ID NO: 35144 - DNA, 349 bp, Artificial
  Mutation in BnaC.FAD2.a introduced by TALE nuclease pair BnFAD2_T03
caggatccatgggtgcaggtggaagaatgcaagtctctcctccatccagctcccccgaaaccaaaaccctcaaacgcgtcccctgcgagacaccacccttcactcagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35145 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttactgcccgctcctccctcaccctctctcctacttcgcctggcctctctactgggcctgccaagggtgcgtcctaaccggcgtctgggtcatagcccacgagtgcggccaccacgccttcagcgactac

SEQ ID NO: 35146 - DNA, 346 bp, Artificial
  Mutation in BnaC.FAD2.a introduced by TALE nuclease pair BnFAD2_T03
caggatccatgggtgcaggtggaagaatgcaagtgtctcatccctccaagaagtctgaaaccgacaccatcaagcgcgtaccctgcgagacaccgcccttcactaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtccgaacgggcctctgggtcatagcccacgagtgcggccaccacgccttcagcgactac

SEQ ID NO: 35147 - DNA, 318 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgccctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 35148 - DNA, 279 bp, Artificial
  Mutation in BnaC.FAD2.a introduced by TALE nuclease pair BnFAD2_T03
caggatccatgggtgcaggtggaagaatgcaagtctctcctccctccagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35149 - DNA, 336 bp, Artificial
  Mutation in BnaC.FAD2.a introduced by TALE nuclease pair BnFAD2_T03
caggatccatgggtgcaggtggaagaatgcaagtgtctcctccatccaagaagtctgaaaccgacaccatcaagcgcgtaccctgcgagacaccgcccttcactgtagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35150 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctccatccctcgctccttctcctacctcctcttcgacatcctcgtctcctcctccctctaccacctctccacagcctacttccctctcctcccccaccctctctcctacttcgcctggcctctctactgggcctgccaagggtgcgtccgaaccggcgtctgggtcagatcccacgagtgcggccaccacgccttcagcgactac

SEQ ID NO: 35151 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcacagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35152 - DNA, 348 bp, Artificial
  Mutation in BnaC.FAD2.a introduced by TALE nuclease pair BnFAD2_T03
caggatccatgggtgcaggtggaagaatgcaagtgtcccctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatagcccacgagtgcggccaccacgccttcaggactac

SEQ ID NO: 35153 - DNA, 344 bp, Artificial
  Mutation in BnaC.FAD2.a introduced by TALE nuclease pair BnFAD2_T03
caggatccatgggtgcaggtggaagaatgcaagtctatcctccctccagctcccccggaaccaacaccctcaagcgcgtaccctgcgagacaccgacgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagttcggccaccacgccttcagcgactac

SEQ ID NO: 35154 - DNA, 342 bp, Artificial
  Mutation in BnaC.FAD2.a introduced by TALE nuclease pair BnFAD2_T03
caggatccatgggtgcaggtggaagaatgcaagtgtctcacccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35155 - DNA, 314 bp, Artificial
  Mutation in BnaC.FAD2.a introduced by TALE nuclease pair BnFAD2_T03
caggatccatgggtgcaggttgaagaatgcaagtgtctcctccctccaagaagtctgaaaccgacaccatcaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 35156 - DNA, 403 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtctccagcggctgttgccgccatcgtggctggcgatggccaccacctgctccggagaactcaagaaagcattcccaccgcactgtttcaaacgctcgatccctcgctctttctcctacctcatctgggacatcatcatagcctcctgcttctactacgtcgccaccacttacgtccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 35157 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgggcctctctactgggcctgccaagggtgcgtcctaaccggcgtctgggtcatagcccacgagtgcggccaccacgccttcagcgactac

SEQ ID NO: 35158 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatcgcccacgagtgcggccaccacgccttcagcgactac

SEQ ID NO: 35159 - DNA, 436 bp, Artificial
  Mutation in BnaC.FAD2.a introduced by TALE nuclease pair BnFAD2_T03
caggatccatgggtgcagggggaagaatgcaagtctgtcatccctccaagaagtctgaaaccgacaccatcaagcgcgtaccctacgagacaccgcccttcacggtccagcggctgttgccggtgctgtgcacggcccacggcttgaacccccagcaggcagtgaccatagcccgcaatggcggtggcacggagaaatcaagaaagcaatccccccccaccggttcaaacgctcgatcccccgctctttcgcctacctcatctgggacatcatcatagcctcctgcttctactccgtcgccaccacttacttccctctcctccctcaccctctctcctacttcgcctggcctctctactgggccggccaagggtgcgtcctaaccggcgtcttggtcagagccctcgagtgcggccaccacgccttcagcgactac

SEQ ID NO: 35160 - DNA, 345 bp, Artificial
  Mutation in BnaC.FAD2.a introduced by TALE nuclease pair BnFAD2_T03
caggatccatgggtgcaggcggaagaatgcaagtgtctcctccctccaaaaagtctgaaaccgacaccatcaagcgcgtaccctgcgagacaccgcccttcactgttcaagaaagcaatcccaccgcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 35161 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcatcgactac

SEQ ID NO: 35162 - DNA, 381 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgaggcatttctgtcctggctggtctagaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 35163 - DNA, 334 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35164 - DNA, 337 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcagacctcacgaaaacactcccccctcactgcttcacacactccctcccccgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 35165 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccaaggctgcttcctaacgggcctctgggtcatcgcccacgaatgcggccaccacgccttcagcgactac

SEQ ID NO: 35166 - DNA, 334 bp, Artificial
  Mutation in BnaC.FAD2.a introduced by TALE nuclease pair BnFAD2_T03
caggatccatgggtgcaggtcgaagaatgcaagtgtatcattcttccaagaagtctgaaaccgacaccatcaagcacgtaccccgcgagacaccgcccttcactgtatcccaccgcactgtttcaaacgctcgatccctcgctctttctcctacctcatctgggacatcatcatagcctcctgcttctactacgtcgccaccacttactcccctctcctccctcaccctctctcctacttcgcctggcctctctactgggcctgccaagggtgcgtcctaaccggcgtctggttcatagcgcacgagttctgccaccacgccttcagcgactac

SEQ ID NO: 35167 - DNA, 328 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35168 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35169 - DNA, 348 bp, Artificial
  Mutation in BnaC.FAD2.a introduced by TALE nuclease pair BnFAD2_T03
caggatccatgggtgcaggtagaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35170 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 35171 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcgaactcaagaaagcaatcccaccgcaccgtttcaaacgctcgaaccctcgctcttcctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35172 - DNA, 345 bp, Artificial
  Mutation in BnaC.FAD2.a introduced by TALE nuclease pair BnFAD2_T03
caggatccatgggtgcaggtgcaagaatgcaagtctctcctccctccagctcccccggaaccaacaccctcaaacgcgtcccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35173 - DNA, 349 bp, Artificial
  Mutation in BnaC.FAD2.a introduced by TALE nuclease pair BnFAD2_T03
caggatccatgggtgcaggtggaagaatgcaagtctctcatccctccagctcccccgaaaccaaaaccctcaaacgcgtcccctgcgagacaccacccttcactgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccatcagcgactac

SEQ ID NO: 35174 - DNA, 342 bp, Artificial
  Mutation in BnaC.FAD2.a introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcaagaaagcaatcccacctcactgcttcaaacgctccatccctcgctacttctcctacctcatctgggacatcatcatatcctcctgcttctactacgtcgccaccacttacttccctctcctccctcaccctctctcctacttcgcctggcctctctactgggcctgccaagggtgcgtccgaaccggcgtctgggtcatagcccacgagtgcggccaccacgccttcagcgactac

SEQ ID NO: 35175 - DNA, 350 bp, Artificial
  Mutation in BnaC.FAD2.a introduced by TALE nuclease pair BnFAD2_T03
caggatccatgggtgcaggtggaagaatgcaagtctcacctccctccagctcccccgaaaccaaaaccctcaaacgcgtcccctgcgagacaccacccttcactccagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgggcctctctactgggcctgccaaggctgcgtcctaacgggcctcggggtcatcgcccacgaatgcggccaccacgccttcagcgactac

SEQ ID NO: 35176 - DNA, 348 bp, Artificial
  Mutation in BnaC.FAD2.a introduced by TALE nuclease pair BnFAD2_T03
caggatccatgggtgcaggtggaagaatgcaagtgtctccttcctacaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagcgtgcgtcctaaccggcgtctggatcatagcccacgagttcggccaccacgccttcatcgactac

SEQ ID NO: 35177 - DNA, 351 bp, Artificial
  Mutation in BnaC.FAD2.a introduced by TALE nuclease pair BnFAD2_T03
caggatccatgggtgcaggtggaagaatgcaagtctatcctccctccagctcccccgaaaccaaaaccctcaaacgcgtcccctgcgagacaccaccattcactcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35178 - DNA, 349 bp, Artificial
  Mutation in BnaC.FAD2.a introduced by TALE nuclease pair BnFAD2_T03
caggatccatgggtgcaggtggaagaatgcaagtgtctccttcctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctggggcatatcccacgagtgcggccaccacgccatcagcgactac

SEQ ID NO: 35179 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcagaactcaagaaagcaatcccaccgcactgtttcaaacgctcgatccctcgctctttctcctacctcatctgggtcatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 35180 - DNA, 436 bp, Artificial
  Mutation in BnaC.FAD2.a introduced by TALE nuclease pair BnFAD2_T03
caggatccatgggtgcaggtgaaagaatgaaagtctctcctccctccagctcccccgaaaccaaaaccctcaaacgcgtcccctgcgagacaccacccttcactctcgcaatttctttatttctgttttacgtgcaactaattttgatatggtaggttctaacccttccattattcagaagtataatccaaacaacctcaagaaagcaatcccacctcactgtttcaaacgctcgatccctcgctctttctcctacctcatctgtgacatcatcatagcctcctgcttctactacgccgccaccacttacttccctctcctccctcaccctctctcctacttcgcctggcctctctactgggcctgccaagggtgcgtcctaaccggcgtctgggtcatagcccacgagtgcggccaccacgccttcatcgactac

SEQ ID NO: 35181 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 35182 - DNA, 331 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacaactcaagaaagcaatcccaccgcactatttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35183 - DNA, 350 bp, Artificial
  Mutation in BnaC.FAD2.a introduced by TALE nuclease pair BnFAD2_T03
caggatccatgggtgcaggcgcaagaatgcaagtgtctcctccatccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcctctgggtcatagcccacgagtgcggccaccacgccttcagcgactac

SEQ ID NO: 35184 - DNA, 349 bp, Artificial
  Mutation in BnaC.FAD2.a introduced by TALE nuclease pair BnFAD2_T03
caggatccatgggtgcaggtggaagaatgcaagtctctcgtccctccaagaagtctgaaaccgacaccatcaagcgcgtaccctgcgagacaccgcccttcactgagaactcaagaaagcaatcccaccgcactgtttcaaccgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35185 - DNA, 348 bp, Artificial
  Mutation in BnaC.FAD2.a introduced by TALE nuclease pair BnFAD2_T03
caggatccatgggtgcatgtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35186 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccctcaagcgcgtaccctgcgagacaccgcccttcactgtagaactcaagaaagcaatcccaccgcactgtttcaaacgctcgatcactccctctttctcctacctcatctcggccctcatcataccctcctgcttctactacgtcgccacctcttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35187 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatccccccccactgcttcaaacgctccttccctcgctctttctcctacctcatctgcgacatcatcatagcctccttcttcttctacctctccaccacttacttccctctcctccctcaccctctcccctacttcgcctggcccctctactgggcctgccaagggtgcgtcctaacgggcctctggggcatagcccacgagtgcggccaccacgccttcagcgactac

SEQ ID NO: 35188 - DNA, 349 bp, Artificial
  Mutation in BnaC.FAD2.a introduced by TALE nuclease pair BnFAD2_T03
caggatccatgggtgcaggtggaagaatgcaagtgtcacatccctacaagaagtctgaaaccgacaccatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35189 - DNA, 280 bp, Artificial
  Mutation in BnaC.FAD2.a introduced by TALE nuclease pair BnFAD2_T03
caggatccatgggtgcaggtggaagaatgcaagtgtcacctccctccaaaaagtctgaaaccgacaccatcaagcgcgtaccctgcgagacaccgcccttcactgtcgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35190 - DNA, 351 bp, Artificial
  Mutation in BnaC.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35191 - DNA, 354 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatagcccacgagtgcggccaccacgccttcagcgactac

SEQ ID NO: 35192 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcattgcccacgagtgcggcctccacgccttcggcgactac

SEQ ID NO: 35193 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctatactgggcctgccaagggtgcgtcataaccggcgtctgggtcatagcccacgagtgcggccaccacgccttcagcgactac

SEQ ID NO: 35194 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 35195 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaaggctgcgtcctaacgggcctctgggtcatcgcccacgaatgcggccaccacgccttcagcgactac

SEQ ID NO: 35196 - DNA, 414 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactctcggcttgaccccggagcaggtggtggccatcgccagccacgatggcggcaacagccgctggaccagacctcaagaaagtaatcccacctcactgcttcaaacgctccatccctcgctccttctcctacctccccttcgacctcctcgtctcctcctccctctaccacctctccacagccttcttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 35197 - DNA, 268 bp, Artificial
  Mutation in BnaC.FAD2.b introduced by TALE nuclease pair BnFAD2_T03
caggatccatgggtgcaggtggaagaatgcaagtgtctcctccctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35198 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35199 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35200 - DNA, 339 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccagggctgcgtcctaaccggcgtctgggtcatagcccacgagtgcggccaccacgccttcagcgactac

SEQ ID NO: 35201 - DNA, 348 bp, Artificial
  Mutation in BnaC.FAD2.b introduced by TALE nuclease pair BnFAD2_T03
catgatccatgggtgcaggtggaagaatgcaagtctctcctccctccagctcccccgaaaccaaaaccctcaaacgcgtcccctgcgagacaccacccttcactctacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcggcctaaccggcgtctgggtcatagcccacgagtgcggccaccacgccttcagcgactac

SEQ ID NO: 35202 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35203 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 35204 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35205 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35206 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 35207 - DNA, 305 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccctacactgtttcaaacgctcgatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35208 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35209 - DNA, 357 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactctccgccggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatcgcccacgaatgcggccaccacgccttcagcgactac

SEQ ID NO: 35210 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaagcccacctcactgcttgaaacactccatccctcgctccttctcctacctcctcttcgacatcctcgtcccctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35211 - DNA, 309 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35212 - DNA, 416 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccagcaatattggtggcaacgaacaggtcactatcagtcaaaataaaatcattatttgccatgtacgaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35213 - DNA, 305 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35214 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctaccgcctctacgacaacctcgtctccgcccccctctaccacctctccacagcctacttccctctcctcccccgccctcacccttaccacgcccggcccctctacagggcctgccaaggctgcgccctaacgggcctgtgggtcatcgcccacgaacacggccaccacgccttcagcgatac

SEQ ID NO: 35215 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 35216 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35217 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 35218 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35219 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 35220 - DNA, 399 bp, Artificial
  Mutation in BnaC.FAD2.b introduced by TALE nuclease pair BnFAD2_T03
caggatccattggtgcaggtggaagaatgcaagtctctcctccctccagctcccccgaaaccaaaaccctcaaacgcgtcccctgcgagacaccacccataccggccaccacctgctggggggtcaagccgtgggcctggcacagcaccggcaacagccgctggaccggagacctcaagaaagcaatcccacctcactgcttcaaacgctccatcccacgctccttctcctcttcgacatcatcatctcctcctcggctcctccccctcccccctccccacagcctccttccctctcccttccctcgcctgccccctctactgggcctgccaaggctgcgtcctaacgggcctctgggtcatagcccacgagtgcggccaccacgccttcagcgactac

SEQ ID NO: 35221 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacttcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35222 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35223 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 35224 - DNA, 360 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccatcccacgctccttctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35225 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttgagacctcaagacagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35226 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35227 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35228 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactagacctcaagaaagcaaccccaccccactgcttcaaacgctccatcccaccccccttctcctctccgacatcatcatctcctcctcggctcctccctctaccacctccccacagcctacttccctctcccttacctcgcctgacccctctacggggcctgccaaggctgcgtcctaacgggcctctgggtcatagcccacgagtgcggccaccacgccttcagcgactac

SEQ ID NO: 35229 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35230 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccagggctgcgtcctaaccggcgtctgggtcatagcccacgagtgcggccaccacgccttcagcgactac

SEQ ID NO: 35231 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35232 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35233 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgcaaccaaaaccctcaaacgcgtcccctgcgagacaccacccttcactcagacctcaagaaagcaatcccacctcactgcttcaaacgctccatccctctctccttctcctacctcctcttcgacatcctagtctcctcctccctctaccacctctccacagcctacttccctctcctcccccgccctctcccttgcctcgcctggcccctctactgggcctgccaaggctgcgtcctaacgggcctctgggtcatcgcccacgaatgcggccaccacgccttcagcgactac

SEQ ID NO: 35234 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgccccatcccacgctccttctcctcttcgacatcatcatctcctcctcggctcctccctctcccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 35235 - DNA, 369 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacggtccagcggctgttgccggtgctgtgccaggcccacggcttgcccccggagcaggtggtggccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctcctgggcctgccaaggctgcgtcctaacgggcctctgggtcatagcccacgagtgcggccaccacgccttcagcgactac

SEQ ID NO: 35236 - DNA, 428 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtcggtgctgtgccaggcccacggcttgaccccgtagcaggtggtggccatcgccagccacgatggcggcaagcaggcggagaactcaagaaagcaatcccaccgcactgtttcaaacgctcgatccctcgctctttctcctacctcatctgggacatcatcatagcctcctgcttctactacgtcgcccccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35237 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35238 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35239 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35240 - DNA, 321 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccataaaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35241 - DNA, 331 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35242 - DNA, 380 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggtgccaggcccacggcttgaccccccagcaggtggtggccagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 35243 - DNA, 354 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggagacctcaagaaagcaatcccacctcactgcttcaaacgctccatccctcgctccttctcctacctcctcttcgacatcctcgtctcctcctccctctaccacctctccacagcctacttccctctcctccccaaccctctcccttacctcgcatggcccctctactgggcctgccaaggctgtgtcctaacgggcctctgggtcatcgcccacgaatgcggccaccacgccttcagcgactac

SEQ ID NO: 35244 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcacccaccctctcccttacctcgcctggcccctctactgggcctgccaaggctgcgtcctaacgggcctctgggtcatcgcccacgaatgcggccaccacgccttcagcgactac

SEQ ID NO: 35245 - DNA, 329 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35246 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35247 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 35248 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35249 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacttagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 35250 - DNA, 350 bp, Artificial
  Mutation in BnaC.FAD2.b introduced by TALE nuclease pair BnFAD2_T03
caggatccatgggtgcaggtggaagaatgcaagtctgtcctccctccagctcccccgaaaccaaaaccctcaaacgcgtcacctgcgagacaacacccttcactctagacctcaagaaagcaatcccacctcactgcttcaaacgctccatccctcgctccttctcctacctcctcttcgacatcctcgtctcctcctccctctaccacctctccccagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35251 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 35252 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35253 - DNA, 400 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctggcaacgctgcgatcatgtcctgatacttgacagcgacggtccctttcgcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgtcaaggctgcgtcctaacgggcctctgggtcatagcccacgagtgcggccaccacgccttcagcgactac

SEQ ID NO: 35254 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35255 - DNA, 465 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacgctcactgcccgctttccagtcgggaaacctgtcgtgccagctgcattaatgaatcggccaacgcgcggggagaggcggatttcggaattggggctcttccgcttcctcccccactggctcgccgcgcccggagacctcaagaaagcaatcccacctcactgcttcaaccgctccaccccaccctcctcctcctcttcgccaccatcatctcctcctcggctcctccctctcccacctccccacagcctacttccctctcccttacctcgcctgacccctctactgggcctgccaaggctgcgtcctaacgggcctctgggtcatagcccacgagtgcggccaccacgccttcagcgactac

SEQ ID NO: 35256 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35257 - DNA, 282 bp, Artificial
  Mutation in BnaC.FAD2.b introduced by TALE nuclease pair BnFAD2_T03
caggatccatgggtgcaggtggaagaatgcaagtctctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 35258 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacatgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35259 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagacgtctgaaaccgacaccctcaagcgcgtaccctgcgagacaccgcccttcactagcactcaagaaagcaatcccacctcactgctccaaacgcgccatcccacccgccttctcctacctcctcttcgacatcctcgtctcctcctccctctaccacctctccccatcctacttccctctccccccccaccctctcccttacctcgcctgacccctctactgggcctgccaaggctgcgtcctaacgggcctctgggtcatagcccacgagtgcggccaccacgccttcagcgactac

SEQ ID NO: 35260 - DNA, 382 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctggcgatggccaccgccattcactcggggggtcaagccgtgggcctggcacagcaccggcaacagccgcagacctcaagaaagcaatcccacctcactgcttcaaacgctccatcccacgctccttctcctcttcgacatcatcatctcctcctcggctcctccctctcccacctctccacagcctacttccctctcccttacctcgcctgccccctctactgggcctgccaaggctgcgtcctaacgggcctctgggtcatagcccacgagtgcggccaccacgccttcagcgactac

SEQ ID NO: 35261 - DNA, 438 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactctcggcaacagccgctggaccgttgctgtgccaggcccacggcttgaccccccagcaggtggtggccatcgccagcaatggcggtggcggagacctcaagaaagcaatcccacctcactgcttcaaacgctccatccctcgctccttctcctaccccctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35262 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35263 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 35264 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35265 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 35266 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactaaagcaatcctacctcacttcttcaaacgctccatcccacgctccttctcctcttcgccatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35267 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccacctcactgcttcaaacgctccatcccacgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35268 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35269 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttcccgcgcctggcccctctactgggcctgccaaggctgcgtcctaacgggcctctgggtcatcgcccacgaatgcggccaccacgccttcagcgactac

SEQ ID NO: 35270 - DNA, 349 bp, Artificial
  Mutation in BnaC.FAD2.b introduced by TALE nuclease pair BnFAD2_T03
caggatccatgggtgcagggtggaagaatgcaagtctctcctccctccagctcccccgaaaccaaaaccctcaaacgcgtcccctgcgagacaccacccttcactctacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35271 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccaagagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctaccaaggctgcgtcctaacgggcctctgggtcatcgcccacgaatgcggccaccacgccttcagcgactac

SEQ ID NO: 35272 - DNA, 339 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactaacctcaaccacacgaacccacctccctgcctctacttcaacctccccctccccttctcctacttccctttcacatcatcctcccctccaccgctcctccccctcccacctccccacttcctacttccctctcccttacctcgcctggcccctctactgggcctgccaaggctgcgtcctaacgggcctctgggtcatcgcccacgaatgcggccaccacgccttcagcgactac

SEQ ID NO: 35273 - DNA, 430 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttaggttccgccaccctgacgagcatcacaaaaatcgacgctcatccagcgcctgttgccggtgctgtgccaggcccacggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35274 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35275 - DNA, 344 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35276 - DNA, 333 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35277 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactgacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35278 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacggcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 35279 - DNA, 278 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35280 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35281 - DNA, 296 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35282 - DNA, 339 bp, Artificial
  Mutation in BnaC.FAD2.b introduced by TALE nuclease pair BnFAD2_T03
caggatccatgggtgcaggtggaagaatgcaagactctcctccctccagctcccccgaaaccaaaaccctcaaacgcgtcccctgcgagacaccaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggccggccaaggcggcgtactaacaggcctctgggtcatagcccacgagtgcggccaccacgccttcagcgactac

SEQ ID NO: 35283 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35284 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctgacctcaagaaagcaagcccacctcactgcttcaaacgctccatccctcgctccttctcctacctcctcttcgacatcctcgtctcctcctccctctaccacctctccacagcctacttccctctcccccccccccctctcccttacctcgcctggcccctctactgggcctgccaaggctgcgtcctaacgggcctctgggtcatcgcccacgaatgcggccaccacgccttcagcgactac

SEQ ID NO: 35285 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35286 - DNA, 306 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacctcaagaaagcaatcccacctcactgcttcaaacgctccatccctcgctccttctcctacctcctcttcgacatcctcgtctcctcctccctcaccctctctcctacttcgcctggcctctctactgggcctgccagggctgcgtcctaaccggcgtctgggtcatagcccacgagtgcggccaccacgccttcagcgactac

SEQ ID NO: 35287 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35288 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccaccgcactgtttcaaacgctcgatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35289 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35290 - DNA, 321 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctccatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35291 - DNA, 380 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgggtcaagccgtgggcctggcacagcaccggcaacagccgctggagagacctcaagaaagcaatcccacctcactgcttcaaacgctccatccctcgctccttctcctacctcctcttcgacatcctcgtctcctcctccctctaccccctccccacagcctacttccctctcccttacctcgcctgacccctctactgggcctgccaaggctgcgtcctaacgggcctctgggtcatagcccacgagtgcggccaccacgccttcagcgactac

SEQ ID NO: 35292 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgaccac

SEQ ID NO: 35293 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 35294 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35295 - DNA, 352 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactctgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35296 - DNA, 350 bp, Artificial
  Mutation in BnaC.FAD2.b introduced by TALE nuclease pair BnFAD2_T03
caggatccatgggtgcaggtggaagaatgcaagtctctcctccctccagctccccagaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccacactctcccttacctcgcctggcccctctactgggcctgccaaggctgcgtcctaacgggcctctgggtcatcgcccacgaatgcggccaccacgccttcagcgactac

SEQ ID NO: 35297 - DNA, 329 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35298 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgacctcaagaaagcaatcccacctcactgcttcaaacgctccatcccacgctccttctcctcttcgacatcatcatctcctcctcggctcctccctctaccaccgctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35299 - DNA, 318 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggagacctcaagaaagcaatcccacctcactgcttcaaacgctccatccctcgctccttctcctacctcctcttcgacatcctcgtctcctcctccctctaccacctctcctacttcgcctggcctctctactgggcctgccaagggtgcgtcctaaccggcgtctgggtcatagcccacgagtgcggccaccacgccttcagcgactac

SEQ ID NO: 35300 - DNA, 336 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccaccattcactcgagacctcaagaaagcaatcccacctcactgcttcaaacgctccatcccacgctccttctcctcttcgacatcatcatctcctcctcggctactccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 35301 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35302 - DNA, 384 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcagggtcaagccgtgggcctggcacagcaccggcaacaggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35303 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgtagagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 35304 - DNA, 306 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 35305 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccccttcagcgactac

SEQ ID NO: 35306 - DNA, 343 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagcgcaagagtgcggccaccacgacttaagcgactac

SEQ ID NO: 35307 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaactcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctcgcctcccccaccctctcccttacctcgcctggcccctctactggacctgccaaggctgcgtcctaacgggcctctgggtcatcgcccacgaatgcggccaccacgccctcagcgactac

SEQ ID NO: 35308 - DNA, 338 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgagaactcaagaaagcaatcccaccgcactgtttcaaacgctcgatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35309 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcccttacctagcctgacccctctactgggcctgccaaggctgcgtcctaacgggcctctgggtcatagcccacgagtgcggccaccacgccttcagcgactac

SEQ ID NO: 35310 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccaactcactgcttcaaacgctccatcccacgctccttctcctcttcgacatcatcatctcctcctcggctcctccctctaccacctctccacagcctacttccctctccattacctcgcctgacccctctactgggcctgccaaggctgcgtcctaacgggcctctgggtcatagcccacgagtgcggccaccacgccttcagcgactac

SEQ ID NO: 35311 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35312 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35313 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctcttcgacatcatcatctcctcctcggctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35314 - DNA, 341 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccccaactcaagaaagcaatcccaccgcactgtttcaaacgctcgatccctcgctccttctcctacctcctcttcgacatcctcgcctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35315 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35316 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatttcggagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaaccggcctctgggtcatagcccacgagtgcggccaccacgccttcagcgactac

SEQ ID NO: 35317 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccaccgcactgtttcaaacgctccatcccacgctccttctcctcttcgacatcctcgtctcctcctcactctaccacctctccacagcctacttccctctcctcccccaccctctaccttacctcgcctggcccctctactgggcctgccaaggctgcgtcctaacgggcctctgggtcatcgcccacgaatgcggccaccacgccttcagcgactac

SEQ ID NO: 35318 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35319 - DNA, 400 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttccaggcccacggcttgaccccccagcaggtggtggccatcgccagcaatggacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35320 - DNA, 379 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggttccatagcgttaaggtttcatttagcgcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35321 - DNA, 321 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagcgagacctcaagaaagcaatcccacctcactgcttcaaacgctccatcccacgctccttctcctcttcgacatcatcatctcctcctcggctcctccctctaccccctctccacagcctacttccctctcccttacctcgcctgacccctctactgggcctgccaaggctgcgtcctaacgggcctctgtgtcatcgcccacgaatgcggccaccacgccttcagcgactcc

SEQ ID NO: 35322 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcacgaaagcaatcccacctcactgcttcaaacgctccatcccacgctccttctcctcttcgacatcatcatctcctcctcggctcctccctctcccacctccccccagcctccttccctctcccctacctcgcctgacccctctactgggcctgccaaggctgcgtcctaacgggcctctgggtcatagcccacgagtgcggccaccacgccttcagcgactac

SEQ ID NO: 35323 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35324 - DNA, 334 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35325 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 35326 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35327 - DNA, 354 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgattgtagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35328 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35329 - DNA, 346 bp, Artificial
  Mutation in BnaC.FAD2.b introduced by TALE nuclease pair BnFAD2_T03
caggatccatgggtgcaggtggaagaatgcaagtctctcctccatccagctcccccgaaaccaaaaccctcaaacgcgtcccctgcgagacaccacccttaaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35330 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35331 - DNA, 382 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgagcgccatctcgaaccgacgttgctggccgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35332 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35333 - DNA, 336 bp, Artificial
  Mutation in BnaC.FAD2.b introduced by TALE nuclease pair BnFAD2_T03
caggatccatgggtgcaggcggaagaatgcaagtctctcctccctccagctcccccggaaccaacacacgcaaacgcgtcccctgcgagacaccaccattaactcgagacctcaagaaagcaatcccacctcactgcttcaaacgctccagccaacgctcctacgcctcttcgaaatcatcaactcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35334 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacgacctcaagaaaacaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35335 - DNA, 404 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctctgacttgagcgtcgatttttgtgatgctcgtcagggggggccatcgccagcaatggcggcggcaggccggcgctggaacctcaagaaagcaatcccacctcactgcttcaaacgctccatcccacgctccttctcctcttcgacatcatcatcgcctccgcggctccgccctctcccacctctccccagcctacttccctctcccttacctcgcctgacccctctacagggcctgccaaggctgcgtcctaacgggcctctgggtcatagcccacgagtgcggccaccacgccttcagcgactac

SEQ ID NO: 35336 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgtggccaccacgccttcagcgactac

SEQ ID NO: 35337 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35338 - DNA, 416 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactctagcgcctgctgccggtgctgtgccaggcccacggcttgaccccccagcaggtggtggccatcgccagcaataatggtggcagacctcaagaaagcaatcccacctcactgcttcaaacgctccatcccacgctccttctcctcttcgacatcatcatcgcctcctcggctcctccctctaccacctctccacagcctacttccctctcccttccctcgcctggcccctctactgggcctgccaaggctgcgtcctaacgggcctctgggtcatcgccaacgaatgcggccaccacgccttcagcgactac

SEQ ID NO: 35339 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35340 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35341 - DNA, 330 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtcccctgcgagacaccaccattcaccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35342 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 35343 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 35344 - DNA, 266 bp, Artificial
  Mutation in BnaC.FAD2.b introduced by TALE nuclease pair BnFAD2_T03
caggatccatgggtgcaggtggaagaatgcaagtctcgacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaaggctgcgtcctaacgggcctctgggtcatcgcccacgaatgcggccaccacgccatcagcgactac

SEQ ID NO: 35345 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35346 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35347 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacacctacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35348 - DNA, 328 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtcccctgcgagacaccaccaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35349 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35350 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccccctcactgcttcaaacgctccatcccacgctccttctcctcttcgacatcatcatctcctcctcggctcctccctctaccacctctccacagccttcttccctctcccttacctcgcctgacccctctactgggcctgccacggctgcgtcctaacgggcctctgggtcatagcccacgagtgcggccaccacgccatcagcgactac

SEQ ID NO: 35351 - DNA, 414 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactggcacagcaccggcaacagccgctggaccgtcaggatggccttctgcttagtttgatgcctggcagtttatggcgggcaggaacctcaagaaagcaatcccacctcactgcttcaaacgctccctcccacgctccttctcctctccgccatcatcacctcctcctcggctcctccccctacctcctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35352 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgtctgacccctctccggggccttccacggctgcgtcctaacgcgcctctgggtcatagcccacgagtgcggccaccacgccttcagcgactac

SEQ ID NO: 35353 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 35354 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 35355 - DNA, 385 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcggggtcaagccgtgggcctggcacagcaccggcaacaggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35356 - DNA, 365 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttgaacgctctcctgagtaggacaaatccgctccctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35357 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactcgagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35358 - DNA, 335 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaaactcaagaaagcaatcccacctcactgcttcaaacgctccaccccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35359 - DNA, 279 bp, Artificial
  Mutation in BnaC.FAD2.b introduced by TALE nuclease pair BnFAD2_T03
caggatccatgggtgcaggtggaagaatgcaagtctctcctccctccagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35360 - DNA, 257 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 35361 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccaccccactgcttcaaacaccccaccccacgctccttctcctcttcgacatcatcatctcctcctcggctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 35362 - DNA, 328 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35363 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 35364 - DNA, 317 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgggagaactcaagaaagcaatcccacctcactgcttcaaacgctccatcccacgctccttctcctcttcgacatcatcatctcctcctcggctcctccctctaccacctctccacagcctacttccctctcccttacctcgtctgacccctctactgggcctgccaaggctgcgtcctaacgggcctctgggtcatagcccacgagtgcggccaccacgccttcagcgactac

SEQ ID NO: 35365 - DNA, 335 bp, Artificial
  Mutation in BnaC.FAD2.b introduced by TALE nuclease pair BnFAD2_T03
caggatccatgggtgcaaggtggaagaatgcaagtctctcctccctccagctcccccgaaaccaaaaccctcaaacgcgtcccctgcgagacaccacccttcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 35366 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35367 - DNA, 348 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35368 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35369 - DNA, 406 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctccagcgcctgcttgccaccattattgctggcgatggccaccacctgctggggggtcaagttgagcggggcacccgtcagtgcattgcgccagagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaagggtgcgtcctaaccggcgtctgggtcatagcccacgagtgcggccaccacgccttcagcgactac

SEQ ID NO: 35370 - DNA, 343 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccgagaactcaagaaagcaatcccaccgcactgtttcaaacgctacatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35371 - DNA, 317 bp, Artificial
  Mutation in BnaC.FAD2.b introduced by TALE nuclease pair BnFAD2_T03
caggatccatgtgtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35372 - DNA, 352 bp, Artificial
  Mutation in BnaC.FAD2.b introduced by TALE nuclease pair BnFAD2_T03
caggatccatgggtgcaggtggaagaatgcaagtggctcctccctccaagaagtctgaaaccgacaccatcaagcgcgtaccctgcgagacaccgcccttcactgtggagaactcaagaaagcaatcccaccgcactggttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35373 - DNA, 352 bp, Artificial
  Mutation in BnaC.FAD2.b introduced by TALE nuclease pair BnFAD2_T03
caggatccatgggtgcaggtggaagaatgcaagtctctcctccctccaaaaagtctgaaaccgacaacatcaagcgcgtcccctgcgagacaccacccttcactctcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35374 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 35375 - DNA, 336 bp, Artificial
  Mutation in BnaC.FAD2.b introduced by TALE nuclease pair BnFAD2_T03
caggatccatgggtgcaggtgggagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgagtgcggccaccacgccttcagcgactac

SEQ ID NO: 35376 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35377 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctactacctcctcttcgacatcctcgtctcctcctccctctaccacctctccacagcctacttccctctcctcccccaccctctcccttaccccgcctgacccctctactgggcctgccaaggctgcgtcctaacgggcctctgggtcatagcccacgagtgcggccaccacgccttcagcgactac

SEQ ID NO: 35378 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactcagacctcaagaaagcaatcccacctcactgcttcaaacgctccatccatcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35379 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttagacctcaagaaagcaatcccacctcactgcttcacacgccccatcccacgctccttctcctcttcgacatcatcatagcctcctgcttctactacgtcgccaccacttacttccctctcctccctcaccctctctcctacctcgcctggcctctctactgggcctgccagggctgcgtcctaaccggcgtctgggtcatagcccacgagtgcggccaccacgccttcagcgactac

SEQ ID NO: 35380 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35381 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35382 - DNA, 369 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgaggcccacggcttgaccccggagcaggtggtggccatcgcctggcacgatggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccactaatgcggccaccacgccttcagcgactac

SEQ ID NO: 35383 - DNA, 417 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggctgttgccggtgctgtgccaggcccacggcttgaccccggagcaggtggtggccatcgccagccacgatggcggcaagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35384 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35385 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 35386 - DNA, 396 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcaggggaagccgaagtttccaaaaggtcgttgatcaaagctcgccgcgttgtttcatcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35387 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcttacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35388 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35389 - DNA, 336 bp, Artificial
  Mutation in BnaC.FAD2.b introduced by TALE nuclease pair BnFAD2_T03
caggatccatgggtgcaggtggaagaatgcaagtctctcctccctccagctaccccggaaccaacaccctcaaacgcgtcccctgcgagacaccaccattcactctagaccccaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35390 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35391 - DNA, 401 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacggtccagcggctgttgccgccatcgtggctggcgatggccaccacctgctccggagaactcaagaaagcaatcccaccgcactgtttcaaacgctccatccctcgctccttctcctacctcctcttcgacatcctcgtctcctcctccctctcccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35392 - DNA, 282 bp, Artificial
  Mutation in BnaC.FAD2.b introduced by TALE nuclease pair BnFAD2_T03
caggatccatgggtgcaggtggaagaatgcaagtctctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35393 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35394 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctatgggtcatcgcccacgaatgcggccaccacgccttcagcgactac

SEQ ID NO: 35395 - DNA, 293 bp, Artificial
  Mutation in BnaC.FAD2.b introduced by TALE nuclease pair BnFAD2_T03
caggatccatgggtgcaggtggaagaatgcaagtctctcctccctccagctcccccggaaccaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35396 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35397 - DNA, 274 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35398 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactacctcaagaaagcaatcccacctcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35399 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgcgcctctgggtcatcgcccacgaatgcggccaccacgccttcagcgactac

SEQ ID NO: 35400 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatgctccttaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35401 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgacctcaagaaagcaatcccacctcactgcttcaaacgctccatccctcgctccttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35402 - DNA, 318 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttactgtttcaaacgctcgatccctcgctccttctcctacctcctcttcgacatcctcgtctcctcctccctctaccacctctccacagcctacttccctctcttcccccaccctctcccttacctcgcctggcccctctactgggcctgccaaggctgcgtcctaacgggcctctgggtcatcgcccacgaatgcggccaccacgccttcagcgactac

SEQ ID NO: 35403 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgacctcaagaaagcaatcccacctcactgcttcaaacgctccatcccactctccttctcctcttcgacatcatcatctcctcctcggctcctcccgctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35404 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatcgcccacgaatgcggccaccacgccttcagcgacta

SEQ ID NO: 35405 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcacctcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35406 - DNA, 336 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35407 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccaccctccttctcctcttcgacatcatcatctcctcctcggctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 35408 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgaggccaccacgccttcagcgactac

SEQ ID NO: 35409 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35410 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacataatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35411 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctaactgcttcaaacgctccatcccacgctccttctcctcttcgacatcatcatctcctcctcggctcctccctctaccacctctccacagcctacttccctctcccttacctcgcctgacccctctactgggcctgccaagactgcgtcctaacgggcctctgggtcatcgcccacgaatgcggccaccacgccttcagcgactac

SEQ ID NO: 35412 - DNA, 397 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgccagccacgatggcggcaagcaggcgctggagacggtccagcggctgttgccggtgctgagacctcaagaaagcaatcccacctcactgcttcaaacgctccatcccacgctccttctccacttcgacatcatcatctcctcctcggctcctccctctaccacctctccacagcctacatccctctcccttacctcgccggacccctctactgggcctgccaaggctgcgtcctaacgggcctctgggtcatcgcccacgaatgcggccaccacgccttcagcgactac

SEQ ID NO: 35413 - DNA, 389 bp, Artificial
  Mutation in BnaC.FAD2.b introduced by TALE nuclease pair BnFAD2_T03
caggatccatgggtgcaggtggaagaatgcaagtctctcctccctcaagctcccccggaaccaacaccctcaaacgcgtcccctgcgagacaccaccattcactcttggcggcggcaggccggcgctggagagcattgttgcccagttatctcgccctgatccctcaagaaagcaatcccacctcactgcttcaaacgctccatcccacgctccttctcctcttcgacatcatcatctcctcctcggctcctccctctcccacctccccacagcctacttccctctcccttacctcgcctgacccctctactgggcctgccaaggctgcgtcctaacgggcctctgggtcatagcccacgagtgcggccaccacgccttcagcgactac

SEQ ID NO: 35414 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctctgagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35415 - DNA, 340 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtactcaagaaagcaatcccacctcactgcttcaaacgctccatccctcgctccttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35416 - DNA, 336 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctcaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35417 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctccttccctctcccttacctcgcctgacccctctactgggcctgccaaggctgcgtcctaacgggcctctggttcatagcccacgagtgcggccaccacgccttcagcgactac

SEQ ID NO: 35418 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcacctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35419 - DNA, 404 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagtcctgtcgggtttcgccacctctgacttgagcgtcgatttttgtgatgctcgtagacctcaagaaagcaatcccacctcactgcttcaaacgctccatcccacgctccttctcctcttcgacatcatcatctcctcctcggctcctccctctaccccctctccacagcctacttccctctcctccccccccctctcccttacctcgcctggcccctctactgggcctgccaaggctgcgtcctaacgggcctctgggtcatcgcccacgaatgcggccaccacgccttcagcgactac

SEQ ID NO: 35420 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 35421 - DNA, 334 bp, Artificial
  Mutation in BnaC.FAD2.b introduced by TALE nuclease pair BnFAD2_T03
caggatccatgggtgaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 35422 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctgacccctctacggggcctgccaaggctgcgtcctaacgggcctctgggtcatagcccacgagtgcggccaccacgccttcagcgactac

SEQ ID NO: 35423 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 35424 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtctcctgcgagacaccacccttcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35425 - DNA, 345 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgctcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35426 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatccctcgctccttctcctacctcctcttcgacatcctcgtcccctcctccctctaccacctctccacagcctacttccctctcctcccccaccctctcccttgcctcgcctggcccctctactgggcctgccaaggctgcgtcctaacgggcctctgggtcatcgcccacgaatgcggccaccacgccttcagcgactac

SEQ ID NO: 35427 - DNA, 272 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacactctcaaacgcgtcccctgcgagacaccaccattcactctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35428 - DNA, 408 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactctctgggtggccatcgccagcaatggcggtggcaagcaggcgctggagacggtccagcggctgttgccggtgcggagacctcaagaaagcaatcccacctcactgcttcaaacgctccatccctccccccttctcctacctcctcttcgacatcctcgtctcctcctccctctcccacctctccccagcctacttccctctcccttccctcgcctgacccctctactgggcctgccaaggctgcgtcctaacgggcctctgggtcatagcccacgagtgcggccaccacgccttcagcgactac

SEQ ID NO: 35429 - DNA, 400 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggtccagcggctgttgccggtgctgggaagccgaagtttccaaaaggtcgttgatcaaacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35430 - DNA, 327 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccgaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35431 - DNA, 348 bp, Artificial
  Mutation in BnaC.FAD2.b introduced by TALE nuclease pair BnFAD2_T03
caggatccatgggtgcaggtggaagaatgcaagtctctcctccctccaggtcccccgaaaccaaaaccctcaaacgcgtaccctgcgagacaccacccttcactctacctcaagaaagcaatccaacctcactgcttcaaacgcaacatccctcgctccttcccctacctcctctccgacatcctcgccgcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35432 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcgacctcaagaaagcaatcccacctcactgcttcaaacgatccatcccacgctccttctcctcttcgacatcatcatctcctcctcggctcctccctctaccacctctccacagcctacttccctctcccttacatcgcctgacccctctactgggcctgccaaggctgcgtcctaacgggcctctgggtcatagcccacgagtgcggccaccacgccttcagcgactac

SEQ ID NO: 35433 - DNA, 348 bp, Artificial
  Mutation in BnaC.FAD2.b introduced by TALE nuclease pair BnFAD2_T03
caggatcatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctactccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35434 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 35435 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35436 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 35437 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 35438 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagtccacgagtgcggccaccacgccttcagcgactac

SEQ ID NO: 35439 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctcttcgacatcatcatctcctcctcggctcctccctctaccacctctccacagcctacttccctctcccttgcctcgcctgacccctctactgggcctgccaaggctgcgtcctaacgggcctctgggtcatagcccacgagtgcggccaccacgccttcagcgactac

SEQ ID NO: 35440 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgagacctcaagaaagcaatcccacctcactgcttcaaacgctccatccctcgctccttctcctacctcctcttcgacatcctcgtctcctcctcctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35441 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttgacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 35442 - DNA, 319 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcctcagcgactac

SEQ ID NO: 35443 - DNA, 350 bp, Artificial
  Mutation in BnaC.FAD2.b introduced by TALE nuclease pair BnFAD2_T03
caggatccatgggtgcaggtggaagaatgctagtctctcctccctccagctcccccgaaaccaaaaccctcaaacgcgtccccggcgaggcaccacccttcacgctagacctcaagaaagcaatcccacctcactgcttcaaccgctccatccctcgctccttctcctacctcctcttcgacatcctcgtctcctcctccctctaccacccctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 35444 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35445 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcatcgactac

SEQ ID NO: 35446 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacacacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35447 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 35448 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35449 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttacctcactgcttcaaacgctccatccctcgctccttctcctacctcctcttcgacatcctcgtctcctcctccctctaccacctctccacagcatacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 35450 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35451 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 35452 - DNA, 336 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagacaccaccattcactcgagacctcaagaaagcaatcccacctcactgcttcaaacgctccatcccacgctccttctcctcttcggcatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35453 - DNA, 330 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgcattcagcgactac

SEQ ID NO: 35454 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggagaccccaagaaaccaatcccaccccactgcttcaaacgctccatcccccgccacttcccctcttcgacatcatcatcgcctcctcggcgcctccctctcccacctccccacagcctacttccctctcccttccctcgcctggcccctctactgggcctgccaaggctgcgtcctaacgggcctctgggtcatagcccacgagtgcggccaccacgccttcagcgactac

SEQ ID NO: 35455 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35456 - DNA, 303 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcactgcttcaaacgctccatctcacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35457 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35458 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 35459 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35460 - DNA, 368 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaacaccatcaacatcgtggctggcgatggccaccacctgtgccaggcccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35461 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgccagacctcaagaaagcaatcccacctcactgcttcaaacgctccatcccacgctccttctcctcttcgccaccatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 35462 - DNA, 306 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35463 - DNA, 313 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctcaccctctctcctacttcgcctggcctctctactgggcctgccaagggtgcgtcctaaccggcgtctgggtcatagcccacgagtgcggccaccacgccttcagcgactac

SEQ ID NO: 35464 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatgctccttaagaaagcaatcccacctcactgcttcaaacgctccatcccacgctccttctcctcttcgacatcatcatctcctcctcggctcctccctctaccacctctccacagcctacttccctctctcctacttcgcctggcctctctactgggcctgccaagggtgcgtcctaaccggcgtctgggtcatagcccacgagtgcggccaccacgccttcagcgactac

SEQ ID NO: 35465 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 35466 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 35467 - DNA, 403 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactcttgctggcgatggccaccacctgctggggggtcaagccgtgggcctggcacagcaccggcaacagccgcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 35468 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccattccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 35469 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgccaacgaatgcggccaccacgccttcagcgactac

SEQ ID NO: 35470 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35471 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacggacctctgggtcatagcccacgagtgcggccaccacgccttcagcgactac

SEQ ID NO: 35472 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaactcctccctcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35473 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35474 - DNA, 319 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35475 - DNA, 336 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacccttcactctagacctcaagaaagcaatcccacctcactgcttcaaacgctccatcccacgctccttctcctcttcgacatcatcatctcctcctcggcacctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35476 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 35477 - DNA, 352 bp, Artificial
  Mutation in BnaC.FAD2.b introduced by TALE nuclease pair BnFAD2_T03
caggccatgggtgcaggtggaagaatgcaagtgtctcctccctccaaaaagtctgaaaccgacaccatcaagcgcgtaccctgcgagacaccgcccttcactgattgtagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 35478 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacctcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35479 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagaccccacccttcactctcagacctcaagcaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggcggcgtcctaacgggcctctgggtcatagcccacgagtgctgccaccacgccttcagcgactac

SEQ ID NO: 35480 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaacaaaaaccctcaaacgcgtcccctgcgagacaccacccttcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctcctgggcctgccaaggctgcgtcctaacgggcctctgggtcatagcccacgagtgcggccaccacgccttcagcgatac

SEQ ID NO: 35481 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35482 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgacta

SEQ ID NO: 35483 - DNA, 381 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggccttctgcttagtttgatgcctggcagtttatggcgggcataagacctcaagaaagcaatcccacctcactgcttcaaacgctccaccccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35484 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35485 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 35486 - DNA, 379 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgccggtgctgtgccaggcccacggcttgaccccccagcaggtggtgggaactcaagaaagcaatcccacctcactgcttcaaacgctccatccctcgctccttctcctacctcctcttcgacatcctcgtctcctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 35487 - DNA, 314 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctcaccctctctcctacttcgcctggcctctctactgggcctgccaagggtgcgtcctaaccggcgtctgggtcatagcccacgagtgcggccaccacgccttcagcgactac

SEQ ID NO: 35488 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35489 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaaacaatcccacctcactgcttcaaacgctccatcccacgctccttctcctcttcgacatcatcatctcctcctccctctaccacctctccacagcctacttccctctcctcccccaccctctcccttacctcgcctgacccctctactgggcctgccaaggctgcgtcctaaccggcgtctgggtcatagcccacgagtgcggccaccacgccttcagcgactac

SEQ ID NO: 35490 - DNA, 265 bp, Artificial
  Mutation in BnaC.FAD2.b introduced by TALE nuclease pair BnFAD2_T03
caggatccatgggtgcaggtggaagaatgcaagtctctcctccctccagtctctccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35491 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35492 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35493 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctaagaccccaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 35494 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35495 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctcccactaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35496 - DNA, 333 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtacggctgcggcgagcggagaactcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35497 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctcccctggcccctctactgggcctgccaaggctgcgtcctaacgggcctctgggtcatagcccacgagtgcggccaccacgccttcagcgactac

SEQ ID NO: 35498 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctcttcgacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35499 - DNA, 410 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattgagcggatttgtcctactcaggagagcgttcaccgacaaacaacagataaaacgaaaggcccagtcttccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35500 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcacctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcgaccaccacgccttcagcgactac

SEQ ID NO: 35501 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcataagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35502 - DNA, 333 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35503 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagacctcaagaaagcaatcccacctcactgcttcaaacgctccacccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35504 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35505 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgtcaaggctgcgtcctaacgggcctctgggtcatagcccacgagtgcggccaccacgccttcagcgactac

SEQ ID NO: 35506 - DNA, 416 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagcgcctgctgccggtgctgtgccaggcccacggcttgaccccccagcaggtggtggccatcgccagcaataatggtggcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaacgggcctctgggtcatcgcccacgaatgcggccaccacgccttcagcgactac

SEQ ID NO: 35507 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35508 - DNA, 339 bp, Artificial
  Mutation in BnaC.FAD2.b introduced by TALE nuclease pair BnFAD2_T03
caggatccatggggcaggtggaagaatgcaagtctctcctccctccagctcccccggaaccaacaccctcaaacgcgtcccctgcgagacaccaccacctcaagaaagcaatcccacctcactgcttcaaacgctccatcccacgctccttctcctcttcgacatcatcatctcctcctcggctcctccctctaccacctctccacagcctacttccctctcctccccccccctctcccttccctcgcctggcccctctactgggcctgccaaggctgcgtcctaacgggcctctgggtcatagcccacgagtgcggccaccacgccttcagcgactac

SEQ ID NO: 35509 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccccctactgggcctgccaaggctgcgtcctaacgggcctctgggtcatagcccacgagtgcggccaccacgccttcagcga

SEQ ID NO: 35510 - DNA, 266 bp, Artificial
  Mutation in BnaC.FAD2.b introduced by TALE nuclease pair BnFAD2_T03
caggatccatgggtgcaggtggaagaatgcaagtctcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35511 - DNA, 358 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaaacgcgtcccctgcgagacaccacccttcactcgagacctcaagaaagcaatcccacctcactgcttcaaacgctccatccctcgctccttctcctacctcctcttcgacatcatcatctcctcctcggctcctccttctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35512 - DNA, 305 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35513 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggggagacctcaagaaagcaatcccacctcactgcttcaaacgctccatcccacgctccttctcctcttcgacatcatcatctcctcctcggctcctccctctaccacctctccacagtctacttccctctctcctacttcgcctggcctctctactgggcctgccaagggtgcgtcctaaccggcgtctgggtcatagcccacgagtgcggccaccacgccttcagcgactac

SEQ ID NO: 35514 - DNA, 384 bp, Artificial
  Mutation in BnaC.FAD2.b introduced by TALE nuclease pair BnFAD2_T03
caggatccatggggtgcaggtggaagaatgcaagtctctcctccctccagctcccccggaaccaacaccctcaaacgcgtcccctgcgaggcccacggcttgaccccggagcaggtggtggccatcgccagccacgatggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35515 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcacctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35516 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaactcctccctcggagacctcaagaaagcaatcccacctcactgcttcaaacgctccatcccacgctccttctcctcttcgacatcatcatctcctcctcggatcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35517 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35518 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35519 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctccatccctcgctccttctcctacctcctcttcgacatcgtcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35520 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacccccaaacgcgtcccctgcgagacaccaccattcactagacctcaagaaagcaatcccacctcactgcttcaaacgctccatcccacgccccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35521 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 35522 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 35523 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctagcgggcctctgggtcatagcccacgagtgcggccaccacgccttcagcgactac

SEQ ID NO: 35524 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacacccccattcactcgagaccccaagaaagcaatcccacctcactgcttcaaacgctccatcccacgctccttctcctcttcgacaccatcatctcctcctctgctcctccctctaccacctctccacatcctacttccctctcccttacctcgcctgacccccataccgggcctgccaaggctgcgtcctcacgggcctctgggtcatagcccacgagtgcggccaccacgccttcagcgactac

SEQ ID NO: 35525 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35526 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35527 - DNA, 428 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctacgagacaccaccgtccagcggctgttgccggtgctgtgccaggcccacggcttgaccccggagcaggtggtggccatcgccagccacgatggcggcaagcaggcgctggagagagacctcaagaaagcaatcccacctcactgcttcaaacgctccatcccacgctccttctcctcttcgacatcatcatctcctcctcggctccgccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35528 - DNA, 306 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35529 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 35530 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccaccctccttctcctcttcgccatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35531 - DNA, 257 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 35532 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagtcaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35533 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaggacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35534 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 35535 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgtgtcctaacgggcctctgggtcatcgcccacgaatgcggccaccacgccttcagcgactac

SEQ ID NO: 35536 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaacgggcctctgggtcatcgcccacgaatgcggccaccacgccttcagcgactac

SEQ ID NO: 35537 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35538 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactcagacctcaagaaagcaatcccacctcactgcttcaaacgctccatccctcgctccttctcctacctcctcttcgacatcctcgtcgcctcctccctctaccacctctccacagcctacttccctctccccccccaccctctcccttacctcgcctggcccctctactgggcctgccaaggctgcgtcctaacgggcctctgggtcatcgcccacgaatgcggccaccacgccttcagcgactac

SEQ ID NO: 35539 - DNA, 382 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaagcgcgtaccctgcgagacaccgcccttcactgtcggttcctggccttttgctggccttttgctcacatgttctttccggagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35540 - DNA, 357 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcgggtgtggtggttacgtagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35541 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35542 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgacaaggctgcgtcctaacgggcctctgggtcatagcccacgagtgcggccaccacgccttcagcgactac

SEQ ID NO: 35543 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgctaaggctgcgtcctaacgggcctctgggtcatagcccacgagtgcggccaccacgccttcagcgactac

SEQ ID NO: 35544 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 35545 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 35546 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctctgagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccagggctgcgtcctaaccggcgtctgggtcatagccaacgagtgcggccaccacgccttcagcgactac

SEQ ID NO: 35547 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccatcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 35548 - DNA, 359 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacattaaccagctgcattaatgaatcggccaactcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35549 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatcccacgctccttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35550 - DNA, 337 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtcccctgcgagacacctacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaaggctgcgtcctaacgggcctatgggtcatagcccacgagtgcggccaccacgccttcagcgactac

SEQ ID NO: 35551 - DNA, 417 bp, Artificial
  Mutation in BnaC.FAD2.b introduced by TALE nuclease pair BnFAD2_T03
caggatccatgggtgcagggtggaagaatgcaagtgtctcctccctccaaaaagtctgaaaccgacaccatcaagcgcgtaccctgcgagacaccgcccttcactgtcggctgttgccggtgctgtgccaggcccacggcttgaccccccagcaggtggtggccatcgccagcaataatggtggcggagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 35552 - DNA, 327 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35553 - DNA, 397 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccatgcgagacaccaccattcactctcgccagccacgatggcggcaagcaggcgctggagacggtccagcggctgttgccggtgctgagacctcaagaaagcaatcccacctcactgcttcaaacgctccatcccaccctccttctcctcttcgacatcatcatctcctcctcggctcctccccctcccacctccccacagcctacttccctctcccttacctcgcctgacccctctactgggcctgccaaggctgcgtcctaacgggcctctgggtcatagcccacgagtgcggccaccacgccttcagcgactac

SEQ ID NO: 35554 - DNA, 347 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcggaaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35555 - DNA, 336 bp, Artificial
  Mutation in BnaC.FAD2.b introduced by TALE nuclease pair BnFAD2_T03
caggatccatgggtgcaggtggaagaatgcaagtctctcatccctccagctcccccggaaccaacaccctcaaacgcgtcccctgcgagacaccaccattcactctagaccccaagaaagcaatcccacctcactgcttcaaccgccccatcccaccctccttctcctcttccacaacatcatctcctcctctgctcctccctctcccacctctccccagcctactcccctctcccttacctcgcctggcccctctactgggcctgccaaggctgcgtcctaacgggcctctgggtcatagcccacgagtgcggccaccacgccttcagcgactac

SEQ ID NO: 35556 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccatgacagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35557 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35558 - DNA, 257 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35559 - DNA, 350 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35560 - DNA, 335 bp, Artificial
  Mutation in BnaC.FAD2.b introduced by TALE nuclease pair BnFAD2_T03
caggatccattggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcttggtcatagcccacgagtgcggccaccacgccttcagcgactac

SEQ ID NO: 35561 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35562 - DNA, 335 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctgacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 35563 - DNA, 405 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttggggggtcaagccgtgggcctggcacagcaccggcaacagccgctggaccgtctccagcgcctgcttgagacctcaagaaagcaatcccacctcactgcttcaaacgctccatcccacgctccttctcctcttcgacatcatcatctcctcctcggctcctccctctcccacctctccacagcctacttccctctcccttccctcgcctgacccctctactgggcctgccaaggctgcgtcctaacgggcctctgggtcatagcccacgagtgcggccaccacgccttcagcgactac

SEQ ID NO: 35564 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccagggctgcgtcctaacgggcctctgggtcatcgcccacgaatgcggccaccacgccttcagcgactac

SEQ ID NO: 35565 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35566 - DNA, 300 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35567 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35568 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgcctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35569 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 35570 - DNA, 291 bp, Artificial
  Mutation in BnaC.FAD2.b introduced by TALE nuclease pair BnFAD2_T03
caggatcaatgggtgcaggtggaagaatgcaagtctctcctccctccagctcccccgaaaccaaaccctcaaacgcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 35571 - DNA, 279 bp, Artificial
  Mutation in BnaC.FAD2.b introduced by TALE nuclease pair BnFAD2_T03
caggatccatgggtgcaggtgtaagaatgcaagtctctcctccctccagctcccccgaaaccaaaaccctcaaacgcgtcccctgcgagacaccacccttcactcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35572 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 35573 - DNA, 333 bp, Artificial
  Mutation in BnaC.FAD2.b introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35574 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggagacctcaagaaagcaatcccacctcactgcttcaaacgctccatcccacgctccttctcctattcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35575 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccgacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35576 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35577 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacacctacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccacaacgccttcagcgactac

SEQ ID NO: 35578 - DNA, 433 bp, Artificial
  Mutation in BnaC.FAD2.b introduced by TALE nuclease pair BnFAD2_T03
caggatccatgggtgcaggtggaagaatgctagtgtctcctccctccaaaaagtctgaaaccgacaacatcaagcgcgtaccctgcgagacaccgcccttcactccagcggctgttgccggtgctgtgccaggcccacggcttgaccccggagcaggtggtggccatcgccagccacgatggcggtggagaactcaagaaagcaatcccacctcactgcttcaaacgctccatcccacgctccttctcctcttcgccatcatcatctcctcctcggctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 35579 - DNA, 352 bp, Artificial
  Mutation in BnaC.FAD2.b introduced by TALE nuclease pair BnFAD2_T03
caggatccatgggtgcaggtggaagaatacaagtgtctcctccctccaagaagtctgaaaccgacaccatcaagcgcgtaccctgcgagacaccgcccttcactgtggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35580 - DNA, 459 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgcgttgaccaacgaccacctcgtcgccttggcctgcctcggcgggcgtcctgcgctggatgcagtgaaaaagggattgggggatcctatcagccgttcccagctggtgaagtccgagctgcggagaactcaagaaagcaatcccacctcactgcttcaaccgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35581 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcatgaaagcaatcccacctcactgcttcaaacgctccatccctcgctccttctcctacctcccctgcgacttcctcctctcctcctccctctaccaccacaccacagcctacttccctctcctcccccaccctctctcctacttcgcctggcctctctactgggcctgccagggctgcgtcctaaccggcgtctgtgtcatagcccacgagtgcggccaccacgccttcagcgactac

SEQ ID NO: 35582 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35583 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccagggctgcgtcctaacgggcctctgggtcatcgcccacgaatgcggccaccacgccttcagcgactac

SEQ ID NO: 35584 - DNA, 365 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggccacgatggcggcaacagccgctggagggagaactcaagaaagcaatcccacctcactgcttcaaacgctccatcccacgctccttctcctcttcgacaccatcatctcctcctcggctcctccctctcccacctctccacagcctccttccctctcccttacctcgcctggcccctctactgggcctgccaaggctgcgtcctaacgggcctctgggtcatagcccacgagtgcggccaccacgccttcagcgactac

SEQ ID NO: 35585 - DNA, 335 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35586 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactctagacctcaagaaagcaatccaacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacaagtgcggccaccacgccttcagcgactac

SEQ ID NO: 35587 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcatctgggacatcatcatagcctcctgcttctactacgtcgccaccacttacttccctctcctcccccaccctctcccttacctcgcctggcccctctactgggcctgccaagactgcgtcctaacgggcctctgggtcatcgcccacgaatgcggccaccacgccttcagcgactac

SEQ ID NO: 35588 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatccactcggacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35589 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgctac

SEQ ID NO: 35590 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35591 - DNA, 419 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcggcaacagccgctggaccgtctccagcgcctgcttgccaccattattgctggcgatggccaccacctgccatcccacgttccagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35592 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 35593 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35594 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35595 - DNA, 393 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgtggacaccaaggcctactccggcggctacaacctgcccatcggccaggccgacgaagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35596 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35597 - DNA, 378 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgcttgaccccggagcaggtggtggccatcaccaaagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 35598 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 35599 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccgcgcctggcccctctactgggcctgccaaggctgcgtcctaacgggcctctgggtcatcgcccacgaatgcggccaccacgccttcagcgactac

SEQ ID NO: 35600 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35601 - DNA, 308 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35602 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 35603 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 35604 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgaaagcaatcccacctcactgcttcaaacgctccatccctcgctccttctcctacctcctcttcgacatcctcgtcgcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 35605 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 35606 - DNA, 350 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccaccattcactcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35607 - DNA, 283 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgcttcaaacgctccatcccacgctccttctcctcttcgacatcatcatctcctcctcggctcctccctcaccctctctcctacttcgcctggcctctctactgggcctgccaagggtgcgtcctaaccggcgtctgggtcatagcccacgagtgcggccaccacgccttcagcgactac

SEQ ID NO: 35608 - DNA, 396 bp, Artificial
  Mutation in BnaC.FAD2.b introduced by TALE nuclease pair BnFAD2_T03
caggatccatgggtgcagctggaagaatgcaagtctctcctccctccagctcccccggaaccaacaccctcaaacgcgtcccctgcgagacaccaccattcactctcggagagcgttcaccgacaaacaacagataaaacgaaaggcccagtcacctcaagaaagcaatcccacctcactgcttcaaacgctccatccctcgctccttctcctcttcgacatcatcatcccctcctcggctcctccctctaccacctccccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 35609 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccacccttcactcgacctcaagaaagcaatcccacctcactgctccaaacgctccatccctcgctccttctcctacctcctctccgacatcatcgtctcctcctccctctaccaccccgccacagcctacttccctctcctccctcaccctctctcctacttcgcctggcctctctactgggcctgccaagggtgcgtcctaacgggcctctgggtcatcgcccacgagtgcggccaccacgccttcagcgactac

SEQ ID NO: 35610 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctagcaggcgctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35611 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgatacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35612 - DNA, 425 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggtcgttcggctgcggcgagcggtatcagctcactcaaaggcggtaatacggttatcacctgtcgcaaatatagtaaaacacttatagagacctcaagaaagcgatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35613 - DNA, 343 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttccctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcacagcccacgagtgcggccaccacgccttcagcgactac

SEQ ID NO: 35614 - DNA, 350 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcacttagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 35615 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35616 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtgagaactcaagaaagcaatcccaccgcactgtttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35617 - DNA, 329 bp, Artificial
  Mutation in BnaC.FAD2.b introduced by TALE nuclease pair BnFAD2_T03
caggatccatgggtgcaggtggaagaatgtaagtgtctcctccctccaaaaagtctgaaaccgacaacatcaagcgcgtaccctgcgagacaccgcccgagacctcaagaaagcaatcccacctcactgcttcaaacgctcaatcccacgctccttctcctcttcgacatcataatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35618 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35619 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 35620 - DNA, 265 bp, Artificial
  Mutation in BnaC.FAD2.b introduced by TALE nuclease pair BnFAD2_T03
caggatccatgggtgcaggtggaagaatgcaagtctctcctccctccagtctctccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 35621 - DNA, 278 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactctcgacatcctcgtctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 35622 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcctcaagaaagcaatcccacctcactgcttcaaacgctccatccctcgctccttctcctacctcctcttcgacatcctcgtctcctcctccctctaccacctctccacagcctacttccctctcctcccccaccctctcccttaccccgcctggcccctctactgggcctgccaaggctgcgtcctaacgggcctctgggtcatcgcccacgaatgcggccaccacgccttcagcgactac

SEQ ID NO: 35623 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacccttcagcgactac

SEQ ID NO: 35624 - DNA, 334 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaacaccctcaaacgcgtcccctgcgagacaccaccattcactctccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35625 - DNA, 319 bp, Artificial
  Mutation in BnaC.FAD2.b introduced by TALE nuclease pair BnFAD2_T03
caggatccatgggtgcaggtggaagaatgcaagtctctcctccctccagctccccggaaccaacaccctcaaacgcgtcccctgcgagacaccaccattcactctatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 35626 - DNA, 405 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcacctgcgagacaccacccttcactctcgcaattaatacgcgtaccgctagccaggaagagtttgtagaaacgcaagacggagacctcaagaaagcaatcccacctcactgcttcaaacgctccatcccacgctccttctcctcttcgacatcatcatctcctcctcggctcctccctctaccgcctctccacagcctacttccctctcctccccctccctctctcctacttcgcctggcctctctactgggcctgccaagggtgcgtcctaaccggcgtctgggtcatagcccacgagtgcggccaccacgccttcagcgactac

SEQ ID NO: 35627 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtaccctgcgagacaccgcccttcactgtcggcggagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35628 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgaatgcggccaccacgccttcagcgactac

SEQ ID NO: 35629 - DNA, 393 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggtccagcggctgttgccggtgctgggaagccgaagtttccaaaaggtcgttgatcaaacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35630 - DNA, 368 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaacaccatcaacatcgtggctggcgatggccaccacctgtgccaggcccacctcaagaaagcaatcccaccccactgcttcaaacgctccatcccacgctccttctcctcttcgacatcaccatctcctcctcggctcctccctctaccacctctccacagcctacttccctctcccttacctcgcctgtcccctctactgggcctgccaaggctgcgtcctaacgggcctctgggtcatagcccacgagtgcggccaccacgccttcagcgactac

SEQ ID NO: 35631 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35632 - DNA, 336 bp, Artificial
  Mutation in BnaC.FAD2.b introduced by TALE nuclease pair BnFAD2_T03
caggatccatgggtgcaggtggaagaatgcaagtctctcctccctccagctccaccggaaccaacaccctcaaacgcgtcccctgcgagacaccaccattcactctagacctcaagaaagcaatcccacctcactgcttcaaacgctccatcccacgccccttctcctcttccacatcatcatcccctcctcggctcctccctctcccacctctccccaccctccttccctctcccttacctcgcctggcccctctactgggcctgccaaggctgcgtcctaacgggcctctgggtcatagcccacgagtgcggccaccacgccttcagcgactac

SEQ ID NO: 35633 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctcccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 35634 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttctagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 35635 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35636 - DNA, 296 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 35637 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 35638 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccatcaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacacctctactgggcctgccaaggctgcgtcctaacgggcctctgggtcatagcccacgagtgcggccaccacgccttcagcgactac

SEQ ID NO: 35639 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcttcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35640 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35641 - DNA, 303 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcactgcttcaaacgctccatctcacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 35642 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcctccccaccctctcccttacctcgcctggcccctctactgggcctgccaaggctgcgtcctaacgggcctctgagtcatcgcccacgaatgcggccaccacgccttcagcgactac

SEQ ID NO: 35643 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccacctcactgcttcaaacgctccatcccacgctccttctcctacctcctcttcgacatcctcgtctcgtcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35644 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 35645 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcatgacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35646 - DNA, 348 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35647 - DNA, 336 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcatgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35648 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35649 - DNA, 342 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35650 - DNA, 351 bp, Artificial
  Mutation in BnaC.FAD2.b introduced by TALE nuclease pair BnFAD2_T03
caggatccatgggtgcaggtggaagaatgcaagtctctcctccctccagcttccccggaaccaacaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 35651 - DNA, 335 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgggaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35652 - DNA, 320 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35653 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccgccctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35654 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcacttagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35655 - DNA, 336 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 35656 - DNA, 401 bp, Artificial
  Mutation in BnaC.FAD2.b introduced by TALE nuclease pair BnFAD2_T03
caggatccatgggtgcaggcggaagaatgcaagtctctcctccctccagctcccccgaaaccaaaaccctcaaacgcgtcccctgcgagacaccacccttcactctcaactatcgtcttgagtccaacccggtaagacacgacttatcgccactggcagcagccactggtaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35657 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtgagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgaatgcggccaccacgccttcagcgactac

SEQ ID NO: 35658 - DNA, 319 bp, Artificial
  Mutation in BnaC.FAD2.b introduced by TALE nuclease pair BnFAD2_T03
caggatccatgggtgccggtggaagaatgcaagtctctcctccctccagctcccccggaaccaacaccctcaaacgcgtcccctgcgagacaccaccattcactcttgacctcaagaaagcaatcccacctcactgcttcaaacttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35659 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagtccacgagtgcggccaccacgccttcagcgactac

SEQ ID NO: 35660 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 35661 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35662 - DNA, 381 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggagagcgttcaccgacaaacaacagataaaacgaaaggcccagtcacctcaagaaagcaatcccacctcactgcttcaaacgctccatcccacgctccttctcctcttcgacatcatcatctcctcctcggctcctccctctcccacctctccacagcctccttccctctcccttccctcgcctgacccctctactgggcctgccaaggctgcgtcctaacgggcctctgggtcatagcccacgagtgcggccaccacgccttcagcgactac

SEQ ID NO: 35663 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35664 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacccgcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35665 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaattccacctcactgcttcaaacgctccatcccacgctccttctcctcctcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35666 - DNA, 459 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgcgttgaccaacgaccacctcgtcgccttggcctgcctcggcgggcgtcctgcgctggatgcagtgaaaaagggattgggggatcctatcagccgttcccagctggtgaagtccgagctgcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35667 - DNA, 356 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35668 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35669 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgaggccaccacgccttcagcgactac

SEQ ID NO: 35670 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35671 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 35672 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgccagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35673 - DNA, 294 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35674 - DNA, 323 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35675 - DNA, 320 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35676 - DNA, 347 bp, Artificial
  Mutation in BnaC.FAD2.b introduced by TALE nuclease pair BnFAD2_T03
caggatccatgggtgcaggtggaagaatgcaagtatctcctccctccaagaagtctgaaaccgacaccatcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacggggcctgccaaggctgcgtcctaacgggcctctgggtcatcgcccacgaatgcggccaccacgccttcagcgactac

SEQ ID NO: 35677 - DNA, 286 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35678 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgccgggcccctctactgggcctgccaaggctgcgtcctaacgggcctctgggtcatcgcccacgaatgcggccaccacgccttcagcgactac

SEQ ID NO: 35679 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35680 - DNA, 333 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35681 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcgagacctcaagaaagcaaacccacctcactgcttcaaaccctccatcccacgctccttctcctcttcgacatcatcatctcctcctcggctcctccctctcccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 35682 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctcttggtcatcgcccacgaatgcggccaccacgccttcagcgactac

SEQ ID NO: 35683 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgatccatcccacgctccttctcctcttcgacatcatcatctcctcctcggctcctccctctaccacctctccacagcctacttccctctcccttacctcgcctgacccctctactgggcctgccaaggctgcgtcataacgggcctctgggtcatagcccacgagtgcggccaccacgccttcagcgactac

SEQ ID NO: 35684 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35685 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccctcaagaaagcaatcccacctcactgcttcaaacgctccatcccacgctccttctcctcttcgacatcatcatctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35686 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcactgtttcacacgctcgatccctcgctccttctcctacctcctcttcgacatcctcgtctcctcctccctctaccacctctccacagcctacttccctctcctcccccaccctctcccttacctcgcctggcccctctacggggcctgccaaggctgcgtcctaacgggcctctgggtcatcgcccacgaatgcggccaccacgccttcagcgactac

SEQ ID NO: 35687 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35688 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 35689 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 35690 - DNA, 319 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 35691 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccatgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35692 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35693 - DNA, 335 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcgcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35694 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 35695 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35696 - DNA, 300 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 35697 - DNA, 351 bp, Artificial
  Mutation in BnaC.FAD2.b introduced by TALE nuclease pair BnFAD2_T03
caggatccatgggcgcaggtggaagaatgcaagtctctcctccctccagctcccccgaaaccaaaaccctcaaacgcgtcccctgcgagacaccacccttcactctcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35698 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35699 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcatcatctcctcctcggctcctccctctaccacctctccacagcctacttccctctctcctacttcgcctggcctctctactgggcctgccaaggctgcgtcctaacgggcctctgggtcatcgcccacgagtgcggccaccacgccttcagcgactac

SEQ ID NO: 35700 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35701 - DNA, 295 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 35702 - DNA, 342 bp, Artificial
  Mutation in BnaC.FAD2.b introduced by TALE nuclease pair BnFAD2_T03
caggatccatgtgtgcaggtggaagaatgcaagtctctcctccctccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctccctctaccgcctctccacagcctacttccctctcctcccccaccctctcccttacctcgccgggcctctctactgggcctgccaagggtgcgtcctaaccggcgtctgggtcatagcccacgagtgcggccaccacgccttcagcgacgac

SEQ ID NO: 35703 - DNA, 304 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35704 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagaaagcaatcccacctcactgcttcaaacgctccatcccacgctccttctcctcttcgacatcatcatctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35705 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 35706 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactggacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35707 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgctgccaccacgccttcagcgactac

SEQ ID NO: 35708 - DNA, 348 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35709 - DNA, 320 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 35710 - DNA, 337 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 35711 - DNA, 383 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacggtccagcggctgttgccggtgctgtgccaggcccacggcttgaccccggagcaggtggtggccagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35712 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 35713 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35714 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagcctgcgtcctaacgggcctctgggtcatagcccacgagtgcggccaccacgccttcagcgactac

SEQ ID NO: 35715 - DNA, 421 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcctacaccgctgtgaagtgctccaccccgtaggtcggataaggcggttacgccttatccaacctacggagacctcaagaaagcaatcccacctcactgcttcaaaccctccatccctcgctccttctcctacctcctctccgacatcctcgtctcctcccccctctcccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35716 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccaccgcactgcttcaaacgctccatcccacgctccttctcctcttcgacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 35717 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccatctactgggcctgccaaggctgcgtcctaacgggcctctgggtcatagcccacgaatgcggccaccacgccttcagcgactac

SEQ ID NO: 35718 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagaaagcaatcccacctcactgcttcaaacgctccatccctcgctccttctcctatctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35719 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35720 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactctagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35721 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccatcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35722 - DNA, 292 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctcaatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35723 - DNA, 418 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctctccagcggctgttgccggtgctgtgccaggcccacggcttgaccccccagcaggtggtggccatcgccagcaataatggggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35724 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccatgacagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 35725 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35726 - DNA, 257 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 35727 - DNA, 416 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttaggctccgcccccctgacgagcatcacaaaaatcgacgctcatccagcgcctgttgccggtactgtgccatgcccacggagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35728 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgccctaacgggcctctgggtcatagcccacgagtgcggccaccacgccttcagcgactac

SEQ ID NO: 35729 - DNA, 320 bp, Artificial
  Mutation in BnaC.FAD2.b introduced by TALE nuclease pair BnFAD2_T03
catgatccatgggtgcaggtggaagaatgcaagtctctcctccctccagctcccccggaaccaacaccctcaaacgcgtcccctgcgagacaccaccattcactctatcccacctcactgcttcaaacgctccatcccacgctccttctcctcttcgacaccatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 35730 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaccgggcctctgggtcatagcccacgagtgcggccaccacgccttcagcgactac

SEQ ID NO: 35731 - DNA, 334 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35732 - DNA, 343 bp, Artificial
  Mutation in BnaC.FAD2.b introduced by TALE nuclease pair BnFAD2_T03
caggatccatgggtgcaggtggaagaatgcaagtctctcctccctccagctaccccggaaccaacaccctcaaacgcgtcccctgcgagacaccaccattcactctcggaaagcaatcccacctcactgcttcaaacgctccatccctcgctccttctcctacctcctcttctacatcctcgtagccccctccctctaccacctccccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35733 - DNA, 357 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 35734 - DNA, 344 bp, Artificial
  Mutation in BnaC.FAD2.b introduced by TALE nuclease pair BnFAD2_T03
caggatccatgggtgcaggtggaagaatgtaagtgtctcctccctccaagaagtctgaaaccgacaccatcaagcgcgtaccctgcgagacaccgcccttcagactcaagaaagcaatcccacctcactgcttcaaacgctccatccctcgctccttctcctacctcctcttcgacatcctcgtctcctcctccctctaccacctctccacagcctacttccctctcctccccccccctctccctttcctcgcctggcccctctactgggcctgccaaggctgcgtcctaacgggcctctgggtcatcgcccacgaatgcggccaccacgccttcagcgactac

SEQ ID NO: 35735 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaacgggcctctgggtcatagcccacgagtgcggccaccacgccttcagcgactac

SEQ ID NO: 35736 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgcctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 35737 - DNA, 320 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctatcccacctcactgcttcaaacgctccatcccaccccccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35738 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccaccgcactgtttcaaacgctcgatcccacgctccttctcctcttcgacatcatcatctcctcctcggctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 35739 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgccagacctcaagaaagcaatcccacctcactgcttcaaacgctccatcccacgctccttctcctcttcgacatcatcatctcctcctcggctcctccctctaccacctctccacagcctacttccctctcccttacctcccctgacccctctactgggcctgccaaggctgcgtcctaacggtcctctgggtcatagcccacgagtgcggccaccacgccttcagcgactac

SEQ ID NO: 35740 - DNA, 331 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35741 - DNA, 282 bp, Artificial
  Mutation in BnaC.FAD2.b introduced by TALE nuclease pair BnFAD2_T03
caggatccatgggtgcaggtggaagaatgcaagtctctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 35742 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctcacgggcctctgggtcatagcccacgagtgcggccaccacgccttcagcgactac

SEQ ID NO: 35743 - DNA, 257 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35744 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctctctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35745 - DNA, 342 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35746 - DNA, 344 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcctctgggtcatcgcccacgaatgcggccaccacgccttcagcgactac

SEQ ID NO: 35747 - DNA, 335 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35748 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35749 - DNA, 274 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35750 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccacctcactgcttcaaacgctccatccctcgctccttctcctacctcctcttcgacatcctcgtctcctcctccatctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 35751 - DNA, 332 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccacctcactgcttcaaacgctccatcccacgctcctctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35752 - DNA, 383 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgaggcccacggcttgaccccggagcaggtggtggccatcgcctggcacgatggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 35753 - DNA, 401 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcgccagccacgatggcggcaagcaggcgctggagacggtccagcggctgttgccggtgctgtgccagacctcaagaaagcaatcccacctcactgcttcaaacgctccatcccacgctccttctcctcttcgacatcatcatctcctcctcggctcctccccctaccacctctccccagcctacttccctctcccttacctcgcctgacccctctactgggcctgccaaggctgcgtcctaacgggcctctgggtcatagcccacgagtgcggccaccacgccttcagcgactac

SEQ ID NO: 35754 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctctcctacttcgcctggcctctctactgggcctgccagggctgcgtcctaacgggcctctgggtcatcgcccacgaatgcggccaccacgccttcagcgactac

SEQ ID NO: 35755 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 35756 - DNA, 356 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcggcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 35757 - DNA, 337 bp, Artificial
  Mutation in BnaC.FAD2.b introduced by TALE nuclease pair BnFAD2_T03
caggatccatgggtgcaggtggaagaatgcaagtctctccttcctccagctcccccggaaccaacaccctcaaccgcgtcccctgcgagacaccaccattcactctaagacctcaagaaagcaatcccacctcactgcttcaaacgctccatctcacgctccttctcctcttcgacatcatcatctcctcctcggctcctccctctaccacctctccacagcctacttccctcgccattacctcgcctggcccctctactgggcctgccaagggtgcgtcctaacgggcctcggggtcatagcccacgagtgcggccaccacgccttcagcgactac

SEQ ID NO: 35758 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctcgcctggcctctctactgggcctgccagggctgcgtcctaaccggcctctgggtcatagcccacgagtgcggccaccacgccttcagcgactac

SEQ ID NO: 35759 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 35760 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagccaccaccattcactccgagacctcaagaaagcaatcccacctcactgcttcaaacgctccatcccacgctccttctcctcttcgacatcatcatctcctcctcggctcctccctctaccacctctccacagcctacttccctctcccttacctcgcctgccccctctactgggcctgccgaggctgcgtcctaacgggcctctgggtcatagcccacgagtgcggccaccacgccttcagcgactac

SEQ ID NO: 35761 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctcacgggcctctgggtcatagcccacgagtgcggccaccacgccttcagcgactac

SEQ ID NO: 35762 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 35763 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacccgtcccctgcgagacaccaccattctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35764 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgattgcggccaccacgccttcagcgactac

SEQ ID NO: 35765 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccagggctgcgtcctaaccggcgtctgggtcatagcccacgagtgcggccaccacgccttcagcgactac

SEQ ID NO: 35766 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaacctcaaacgcgtcccctgcgagacaccaccattcactctaagacctcaagaaagcaatcccacctcactgcttcaaacgctccatcccacgctccttctcctcttcgacatcatcatctcctcctcggctcctccctctaccacctctccacatcctacttccctctcccttacctcgcctgacccctctactgggcctgccaaggctgcgtcctaacgggcctctgggtcatagcccacgagtgcggccaccacgccttcagcgactac

SEQ ID NO: 35767 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35768 - DNA, 349 bp, Artificial
  Mutation in BnaC.FAD2.b introduced by TALE nuclease pair BnFAD2_T03
caggatccatgggtgcaggtggaagaatgcaagtctcccctccatccagctcccccgaaaccaaaaccatcaaacgcgtcccctgcgagacaccacccttcacttagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctggggcatcgcccacgaatgcggccaccacgccttcagcgactac

SEQ ID NO: 35769 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35770 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 35771 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 35772 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35773 - DNA, 329 bp, Artificial
  Mutation in BnaC.FAD2.b introduced by TALE nuclease pair BnFAD2_T03
caggtccatgggtgcaggtggaagaatgcaagtctctcctccctccagctcccccggaaccaacaccctcaaacgcgtcccctgcgagacaccaccattcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35774 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgctcacgaatgcggccaccacgccttcagcgactac

SEQ ID NO: 35775 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35776 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35777 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcggggtcatagcccacgagtgcggccaccacgccttcagcgactac

SEQ ID NO: 35778 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgacctcaagaaagcaatctcacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35779 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 35780 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcctcccacaccctctcccttacctcgcctggcccctctactgggcctgccaaggctgcgtcctaacgggcctctgggtcatcgcccacgaatgcggccaccacgccttcagcgactac

SEQ ID NO: 35781 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 35782 - DNA, 336 bp, Artificial
  Mutation in BnaC.FAD2.b introduced by TALE nuclease pair BnFAD2_T03
caggatccatgggtgcaggtggaagaatgcaagtctcccctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcatcgactac

SEQ ID NO: 35783 - DNA, 349 bp, Artificial
  Mutation in BnaC.FAD2.b introduced by TALE nuclease pair BnFAD2_T03
caggatccatgggtgcaggtggaagaatgcaagtgtctcatccctccaaaaagtctgaaaccgacaacatcaagcgcgtaccctgcgagacaccacacttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35784 - DNA, 356 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccacctcactgcttcaaacgctccatccctcgctccttctcctacctcctcttcgacatcctcgtctcctcctcggctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 35785 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgaaacaccacccttcactgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcggggtcatagcccacgagtgcggccaccacgccgtcagcgactac

SEQ ID NO: 35786 - DNA, 358 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactctcggcctttttacggttcctctccctcccacctcactgcttcaaacgctccatcccacgctccttctcctcttcgacatcatcatctcctcctcggcttctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 35787 - DNA, 335 bp, Artificial
  Mutation in BnaC.FAD2.b introduced by TALE nuclease pair BnFAD2_T03
caggatccatgggcgcaggtggaagaatgcaagtcactcccccttccagctcccccggaaccaacacactcaaacgcgtcccctgcgagaccccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaatgctgcgtcctaacgggcctctgggtcatagctcacgagttcggccaccacgcctttatcgactac

SEQ ID NO: 35788 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcacaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 35789 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatccctcgctccttctcctacctcctcttcgacatcctcgtctcctcctccctctaccacctctccacagcctacttccctctcctcccccaccctctccctttcctcgcctggcccctctactgggcctgccaaggctgcgtcctaacgggcctctgggtcatcgcccacgaatgcggccaccacgccttcagcgactac

SEQ ID NO: 35790 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcacctcaagaaagcaatcccacctcactgcttcaaacgctccatcccacgctccttctcctcttcgacatcatcatctcctcctccctctaccacctctccacagcctacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 35791 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaacctcaaacgcgtcccctgcgagacaccaccattcactgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35792 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccatgacagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaatactgcgtcctaacgggcctctgggtgatcgcccacgaatgcggccaccacgccttcagcgactac

SEQ ID NO: 35793 - DNA, 333 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35794 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35795 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgcggagaactcaagaaagcaatcccaccgcactgtttcaaacgctccatccaacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35796 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcgacctcaagaaagcaatcccacctcactgcttcaaacgccccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 35797 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctccccacagcctacttccctctcccttacctcgcctgacccctctactgggcctgccaaggctgcgtcctaacgggcctctgggtcatagcccacgagtgcggccaccacgccttcagcgactac

SEQ ID NO: 35798 - DNA, 351 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 35799 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35800 - DNA, 348 bp, Artificial
  Mutation in BnaC.FAD2.b introduced by TALE nuclease pair BnFAD2_T03
caggatccatgggtgcaggtggaagaatgcaagtctctcctccctcccgctcccccgaaaccaaaaccctcaaacccgtcccctgcgcgacaccacccttcactctacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtccgaacgggcctggaggtcatcgcccaccaatgcggcctccacgccttgaacgactac

SEQ ID NO: 35801 - DNA, 335 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35802 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35803 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcggggtcatagcccacgagtgcggccaccacgccttcagcgactac

SEQ ID NO: 35804 - DNA, 345 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccaccattcactcttacagcgagcgatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35805 - DNA, 348 bp, Artificial
  Mutation in BnaC.FAD2.b introduced by TALE nuclease pair BnFAD2_T03
caggatccatgggtgcaggtggaagaatgcaagtctgacctccctcaagctccgccgaaaccaaaaccctcaaacgcgtcccctgcgagacaccacccttaactctacctcaagaaagcaatcccacctcactgcttcaaacgctccatccctcgctccttctcctacctcctcttcgacatcctcgtctcctcctccctctaccacctctccacatcctacttccctctcctcccccaccctctcccttacctcgcctcgcccctctactgggcctgccaaggctgcgtccgaaccggcgtggagctcatatcccgcatgtgcggccaccacgccttgagcaactac

SEQ ID NO: 35806 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagcaagcaatcccacctcactgcttcaaacgctccatccctcgctccttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35807 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35808 - DNA, 337 bp, Artificial
  Mutation in BnaC.FAD2.b introduced by TALE nuclease pair BnFAD2_T03
caggatccatgggtgcaggtggaagaatgcaagtctctcctccctccagccggacaggaaccaacaccctcaaacgcgtaagacgcgagacaccaccattcactctcagacctcaagaaagcaatcccaccgcactgtttcaaacgctccatcccacgctccttctcctcttcgacatcatcatctcctccgcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 35809 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35810 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcacctcaagaaaacaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 35811 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgagacctcaagaaagcaatcccacctcactgcttcaaacgctccatccctcactccttctcctacctcctcttcgacatcctcgtctcctcctccctctaccacctctccacagcctacttccctctcctccccccccctctcccttacctcgcctggcccctctactgggcctgccaaggctgcgtcctaacgggcctctgggtcatcgcccacgaatgcggccaccacgccttcagcgactac

SEQ ID NO: 35812 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaattcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35813 - DNA, 310 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccctcaagaaagcaatcccacctcactgcttcaaacgctccatcccacgctccttctcctcttcgacatcatcatctcctcctcggctcctccctcaccctctctcctacttcgcctggcctctctactgggcctgccaaggctgcgtcctaacgggcctctgggtcatcgcccacgaatgcggccaccacgccttcagcgactac

SEQ ID NO: 35814 - DNA, 335 bp, Artificial
  Mutation in BnaC.FAD2.b introduced by TALE nuclease pair BnFAD2_T03
caggatccatgggtgcaggtggaagaatgcaagtctctcctccctacagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcatcgactac

SEQ ID NO: 35815 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactctagacctcaagaaagcaatcccacctcactgcttcaaacgctccatcccacgctccttctcctcttcgacatcatcatctcctcatcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35816 - DNA, 329 bp, Artificial
  Mutation in BnaC.FAD2.b introduced by TALE nuclease pair BnFAD2_T03
caggatccatgggtgcaggtggaagaatgcaagtctctcacccctccagctcccccggaaccaacaccctcaaacgcgtcccctgcgagacaccaccatagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacggtcctctgggtcatagcccacgagtgcggccaccacgccttcagcgactac

SEQ ID NO: 35817 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35818 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttagacctcaagaaagcaaacccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 35819 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatccctcgctccttctcctacctcatctgggacatcatcatagcctcctgcttctactacgtcgccaccacttacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 35820 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggccggccaaggctgcgtcctaacgggcctcttggtcatcgcccacaaatgcggccaccacgccatcaacgactac

SEQ ID NO: 35821 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctctgagacctcaagaaagcaatcccacctcactgcttcaatcgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgcctcagcgactac

SEQ ID NO: 35822 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 35823 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 35824 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcggacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35825 - DNA, 368 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaacaccatcaacatcgtggctggcgatggccaccacctgtgccaggcccacctcaagaaagcaatcccacctcactgcttcaaacgctccatcccacgctccttctcctcttcgacatcatcatctcctcctcggctcctccctctaccacctctccacagcctacttccctctcccttccctcgtctgacccctctactgggcctgccaaggctgcgtcctaacgggcctctgggtcatagcccacgagtgcggccaccacgccttcagcgactac

SEQ ID NO: 35826 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgaatgcggccaccacgccttcagcgactac

SEQ ID NO: 35827 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgaatgcggccaccacgccttcagcgactac

SEQ ID NO: 35828 - DNA, 279 bp, Artificial
  Mutation in BnaC.FAD2.b introduced by TALE nuclease pair BnFAD2_T03
caggatccatgggtgcaggtggaagaatgcaagtctctcctccctccagcaatcccacctcactgcttcaaacgctccatccctcgctccttctcctacctcctcttcgacatcctcgtctcctcctccctctaccacctctccacagcctacttccctctcctcccccaccctctcccttacctcgccttgcccctctactgggcctgccaaggctgcgtcctaacgggcctctgggtcatcgcccacgaatgcggccaccacgccttcagcgactac

SEQ ID NO: 35829 - DNA, 345 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgctcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 35830 - DNA, 333 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcagagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35831 - DNA, 395 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcgggtcaagccgtgggcctggcacagcaccggcaacagccgctggagagacctcaagaaagcaatcccacctcactgcttcaaacgctccatccctcgctccttctcatacctcctcttcgacatcctcgtctcctcctccctctaccacctctccacagcctacgtccctctccgcccccaccctctcccttacctcgcctggcccctctactgggcctgccaaggctgcgtcctaacgggcctcggggtcatcgcccacgaatgcggccaccacgccttcagcgactac

SEQ ID NO: 35832 - DNA, 329 bp, Artificial
  Mutation in BnaC.FAD2.b introduced by TALE nuclease pair BnFAD2_T03
caggatccatgggtgcatgtggaagaatgcaagtctctcctccctccagctcccccggaaccaacaccctcaaacgcgtcccctgcgagacaccacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35833 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcatgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35834 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactggtcctgccaagggtgcgtcctaaccggcgtctgggtcatagcccacgagtgcggccaccacgccttcagcgactac

SEQ ID NO: 35835 - DNA, 329 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35836 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcacctgacccctctactgggccggccaaggctgcgtcctaacgggcctctgggtcatagcccgcgagtgcggccaccacgccatcagcgactac

SEQ ID NO: 35837 - DNA, 354 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgggaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35838 - DNA, 351 bp, Artificial
  Mutation in BnaC.FAD2.b introduced by TALE nuclease pair BnFAD2_T03
caggatccatgggtgcaggtggaagaatgcaagtccctcctccctccagctcccccggaaccaacaccctcaaacgcgtcccctgcgagacaccaccattcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggccggccaaggctgcgtcctaacgggcctctgggtcatcgcccacgaatgcggccaccacgccgtcagcgactac

SEQ ID NO: 35839 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccacctcactgcttcagacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35840 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35841 - DNA, 415 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgccagccacgatggcggcaagcaggcgctggagacggtccagcggctgttgccggtgctgtgccagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35842 - DNA, 348 bp, Artificial
  Mutation in BnaC.FAD2.b introduced by TALE nuclease pair BnFAD2_T03
caggatccatgggtgcaggtggaagaatgcaagtctctcatccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctccctttcctcgcctggcccctctactgggcctgccaaggctgcgtcctaacgggcctctgggtcatcgcccacgaatgcggccaccacgccttcagcgactac

SEQ ID NO: 35843 - DNA, 330 bp, Artificial
  Mutation in BnaC.FAD2.b introduced by TALE nuclease pair BnFAD2_T03
caggatccattggtgcaggtggaagaatgcaagtctctcctccctccagctcccccggaaccaacaccctcaaacgcgtcccctgcgagacaccaccattagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 35844 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgccctaacgggcctctgggtcatcgcccacgaatgcggccaccacgccttcagcgactac

SEQ ID NO: 35845 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35846 - DNA, 300 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 35847 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 35848 - DNA, 336 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35849 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaataaagcaaacccacctcactgcttcaaacgctccatcccacgctccttctcctctccgacatcatcatctcctcctcggctcctccctctcccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 35850 - DNA, 426 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctccccccagcaggtggtggccatcgccagcaatggcggtggcaagcaggcgctggagacggtccagcggctgttgccggtgctgtgccaggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35851 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35852 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccctcaagaaagcaatcccacctcactgcttcaaacgctccatccctcgctccttctcctacctcctcttcgacatcctcgtctcctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 35853 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagccaccaccattcactctagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35854 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctaccgggccggccaaggctgcgtcctaacgggcctctgggtcatagcccacgagtgcggccaccacgccttcagcgactac

SEQ ID NO: 35855 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttacagcgagcgatcccacctcactgcttcaaacgctccatcccacgctccttctcctcttcgacatcatcatctcctcctcggctcctccctctaccacctctccacagcctacttccctctcccttacctcgtctgacccctctactgggcctgccaaggctgcgtcctaacgggcctctgggtcatagcccacgagtgcggccaccacgccttcagcgactac

SEQ ID NO: 35856 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35857 - DNA, 358 bp, Artificial
  Mutation in BnaC.FAD2.b introduced by TALE nuclease pair BnFAD2_T03
caggatccatgggtgcaggtggaaggtgcaggtgtctcctccctccaagaagtctgaaaccgacaacatcaagcgcgtaccctgcgagacactgccaggcatcaaactaagcagaaggccatccgtcaaacgctcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35858 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 35859 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagactgcgtcctaacgggcctctgggtcatagcccacgagtgcggccaccacgccatcagcgactac

SEQ ID NO: 35860 - DNA, 350 bp, Artificial
  Mutation in BnaC.FAD2.b introduced by TALE nuclease pair BnFAD2_T03
caggatccatgggtgcaggtgcaagaatgcaagtgtctcctccctcccaaaagtctgaaaccgacaacatcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgcgcctgccaaggctgcgtcctaacgggcttcttggtcatcgcccacaagtgtggccaccacgccttcagcgactac

SEQ ID NO: 35861 - DNA, 378 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacttttggagcagcaacgatgttacgcagcaggagacctcaagaaagcaatcccacctcattgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 35862 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35863 - DNA, 412 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggctgttgccggtgctgtgccaggcccacggcttgaccccggagcaggtggtggccatcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatcgcccacgagtgcggccaccacgccttcagcgactac

SEQ ID NO: 35864 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccgaaatcaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35865 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccgacaccatcaagcgcgtaccctgcgagacaccgcccttcactgtagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35866 - DNA, 337 bp, Artificial
  Mutation in BnaC.FAD2.b introduced by TALE nuclease pair BnFAD2_T03
caggatccatgggtgcaggtggaagaatgcaagtctctcctccctcccgctcccccgaaaccaaaaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtcctaacgggcctctgggtcatagcccacgagtgcggccaccacgccttcagcgactac

SEQ ID NO: 35867 - DNA, 331 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactaactcaagaaagcaatcccacctcactgcttcaaacgctccatccctcgctccttctcctacctcctcttcgacatcctcgtctcctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 35868 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35869 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35870 - DNA, 345 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggcggcgtcctaacgggcctctgggtcatcgcccacgaatgcggccaccacgccttcagcgactac

SEQ ID NO: 35871 - DNA, 376 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgctgcgtaacatcgttgctgctccagagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35872 - DNA, 370 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccgtccagcggctgttgccggtgttgtgcctggcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35873 - DNA, 307 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctccatccctcgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcatcgactac

SEQ ID NO: 35874 - DNA, 336 bp, Artificial
  Mutation in BnaC.FAD2.b introduced by TALE nuclease pair BnFAD2_T03
caggatccatgggtgcaggtggaagaatgcaagtgtctcctccatccaagaagtctgaaaccgacaccatcaagcgcgtaccctgcgagacaccgcccttcactgtagaactcaagaaagcaatcccacctcactgcttcaaacgctccatcccacgctccttctcctcttcgacatcatcatctcctcctcggcgcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35875 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 35876 - DNA, 342 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactctagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 35877 - DNA, 349 bp, Artificial
  Mutation in BnaC.FAD2.b introduced by TALE nuclease pair BnFAD2_T03
caggatccatgggtgcaggtggaagaatgcaagtctctcctccctccagctccccggaaacaacacccttaaacgcgtcccctgcgagacaccaccattccctcgagacctcaagaaagcaatcccacctcactgcttcaaacgcaccatccctcgctccttctcctacctcctcttcgacatcctcgtttctaccttcctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35878 - DNA, 349 bp, Artificial
  Mutation in BnaC.FAD2.b introduced by TALE nuclease pair BnFAD2_T03
caggatccatggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 35879 - DNA, 308 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacactggagacggtctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35880 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccatctactgggcctgccagggctgcgtcctaaccggcgtctgggtcatagcccacgagtgcggccaccacgccttcagcgactac

SEQ ID NO: 35881 - DNA, 280 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35882 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35883 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 35884 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35885 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35886 - DNA, 263 bp, Artificial
  Mutation in BnaC.FAD2.b introduced by TALE nuclease pair BnFAD2_T03
caggatccatgggtgcaggtggaagaatgcaagtctctcctccctccagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcacgactac

SEQ ID NO: 35887 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35888 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaaacgcgtcccctgttatcgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 35889 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 35890 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagacctcaagaaagcaatcccacctcactgcttcaaacgctccctccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 35891 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagcctgaaaccgacaacatcaagcgcgtaccctgcgagacaccgcccttcactgtgaactcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctggatcatagcccacgagtgcggccaccacgccttcagcgactac

SEQ ID NO: 35892 - DNA, 349 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacggggcctgccaaggctgcgtcctaacgggcctctgggtcatagcccacgagtgcggccaccacgccttcagcgactac

SEQ ID NO: 35893 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35894 - DNA, 348 bp, Artificial
  Mutation in BnaC.FAD2.b introduced by TALE nuclease pair BnFAD2_T03
caggatccatgggtgcaggtggaagaatgcaagtctctcctccctccagctaccccgaaaccaaaaccatcaaacgcgtcccctgcgagacaccacccttcactctaccacaagaaagcaatcccacctcactgcttcaaacgcaccatccctcgctccatctcctacctcctcttcgacatccccgtctcctcccccctctaccacccctccacagcctacttccctctcctcccctcccctctccctttcctcgcctggcccctctactgggcctgccaaggctgcgtcctaacgggcctcggggtcatcgcccacgaatgcggccaccacgccatcagcgactac

SEQ ID NO: 35895 - DNA, 328 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 35896 - DNA, 348 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccgcgcctggcccctctactgggcctgccaaggctgcgtcctaactggccgctgggtcatcgcccacgaatgcggccgccacgccttcagcctac

SEQ ID NO: 35897 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35898 - DNA, 335 bp, Artificial
  Mutation in BnaC.FAD2.b introduced by TALE nuclease pair BnFAD2_T03
caggatccatggggcaggtggaagaatgcaagtgtctcctccctccaaaaagtctgaaaccgacaacatcaagcgcgtaccctgcgagacaccgcccttcactgtaaaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35899 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccctggaaccaacaccctcaaacgcgtcccctgcgagacaccaccattcactgagacctcaagaaagcaatcccacctcactgcttcaaacgctccatcccacgctccctctcctcttcgacatcatcacctcctcctcggctcctccctctaccacctctccacagcctacttcccgctcccttacctcgcctgacccctctactgggcctgccaaggctgcgtcctaacgggcctctgggtcatagcccacgagtgcggccaccacgccttcagcgactac

SEQ ID NO: 35900 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaactcctccctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctgacccctctactggacctgccaaggctgcgtcctaacgggcctctgggtcatagcccacgagtgcggccaccacgccttcagcgactac

SEQ ID NO: 35901 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgtggccaccacgccttcagcgactac

SEQ ID NO: 35902 - DNA, 409 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattccggatggcctttttgcgtttctacaaactcttcctggctagcggtacgcgtattaattgcgttgcgagaccaagaaagcaatcccacctcactgcttcaaacgctccatccctcgctccttctcctacctcctcttcgacatcctcgtctcctcctccctctaccacctctccacagcctacttccctctcctccccccccctctcccttacctcgcctggcccctctactgggcctgccaaggctgcgtcctaacgggcctctgggtcatcgcccacgagtgcggccaccacgccttcagcgactac

SEQ ID NO: 35903 - DNA, 337 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtgagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcggggtcatagcccacgagtgcggccaccacgccttcagcgactac

SEQ ID NO: 35904 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35905 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggacctcaagaaagcaatcccacctcactgcttcaaacgctccatcccacgctccttctcctcttcgacatcatcatctcctcctcggctcctccctctaccacctctccacagcctacttccctctcccttacctcgcctgaccactctactgggcctgccaaggctgcgtcctaacgggcctctgggtcatagcccacgagtgcggccaccacgccttcagcgactac

SEQ ID NO: 35906 - DNA, 340 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccgggcccctctactgggcctgccaaggctgcgtcctaacgggcctctgggtcatagcccacgagtgcggccaccacgccttcagcgactac

SEQ ID NO: 35907 - DNA, 333 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35908 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagaaagcaatcccacctcactgcttcaaacgctccatccctcgctccttctcctatctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgaatgcggccaccacgccatcagcgactac

SEQ ID NO: 35909 - DNA, 278 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 35910 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactaaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35911 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacatgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatatcccacgagtgcggccaccacgccttcagcgactac

SEQ ID NO: 35912 - DNA, 331 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35913 - DNA, 335 bp, Artificial
  Mutation in BnaC.FAD2.b introduced by TALE nuclease pair BnFAD2_T03
caggatccatgggtgcaggttggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35914 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35915 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccgcgagtgcggccaccacgccttcatcgactac

SEQ ID NO: 35916 - DNA, 349 bp, Artificial
  Mutation in BnaC.FAD2.b introduced by TALE nuclease pair BnFAD2_T03
caggatccatgggtgcaggtggaagaatgcaagtctatcctcccttcagctcccccggaaccaacaccctcaaacgcgtcccctgcgagacaccaccattcactctgacctcaagaaagcaatcccacctcactgcttcaaacgctccatccctcgctccttctcctacctcctcttcgacatcctcgtctcctcctccctctaccacctctccacagcctacttccctctcctcccccaccctctccctttcctcgcctggcccctctactgggcctgccaaggctgcgtcctaacgggcctctgggtcatatcccacgagtgcggccaccacgccttcagcgactac

SEQ ID NO: 35917 - DNA, 343 bp, Artificial
  Mutation in BnaC.FAD2.b introduced by TALE nuclease pair BnFAD2_T03
caggatccatgggtgcaggtgcaagaatgcaagtctctcctccctcccgctcccccgaaaccaaaacccacaaacgcgtcccctgcgtgccaccatcggagccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcttcctaacgggcctcggggtcatcgcccacgaatgcggcctccacgccttcatcgactac

SEQ ID NO: 35918 - DNA, 334 bp, Artificial
  Mutation in BnaC.FAD2.b introduced by TALE nuclease pair BnFAD2_T03
caggatccatgggtgcaggtggaagaatgcaagtctctcctccctccagctccaccggaaccaacaccctcaaacgcgtcccctgcgagacaccaccatttcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35919 - DNA, 445 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtccctgcgagacaccaccattcactctcgggcaggtggtggccatcgccagcaatggcggtggcaagcaggcgctggagacggtccagcggctgtttccggtgctgtgccaggcccacggctagacctcaagaaagcaatcccacctcactgcttcaaacgctccatcccacgctccttcccctctccgacatcaccatctcctccccggctcctccctctaccacccctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 35920 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatatcccacgagtgcggccaccacgccttcagcgactac

SEQ ID NO: 35921 - DNA, 336 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35922 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgaacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35923 - DNA, 415 bp, Artificial
  Mutation in BnaC.FAD2.b introduced by TALE nuclease pair BnFAD2_T03
caggatccatgggtgcaggtggaagaatgcaagtctctcctccctccagcttccccgaaaccaaaaccctcaaacgcgtcccctgcgagacaccacccttcactctcggcgctggagacggtccagcggctgttgccggtgctgtgccaggcccacggcttgaccccccagcaggtggtggccatagacctcaagaaagcaatcccacctcactgcttcaaacgctccatcccacgctccttctcctcttcgacatcatcatcccctcctcggctcctccctctaccacctctccacagccttcttccctctcccttccctcgcctgacccctctacggggcctgccaagactgcgtcctaacgggcctcggggtcatagcccacgagtgcggccaccacgccttcagcgactac

SEQ ID NO: 35924 - DNA, 336 bp, Artificial
  Mutation in BnaC.FAD2.b introduced by TALE nuclease pair BnFAD2_T03
caggatccatgggtgcaggtggaagaatgcaagtctatccacctccccgcgcccccggaaccaacacactcaaccgcgtccgccgcgcgacaccaccattcactctcaacctcaagaaagcaatcccacctcactgcttcaaacgctccatcccacgccccttctcctcttcgacatcatcatctcctcctcggcccctccctctaccacctctccacagcctacttccctctcccttacctcgcctgacccctcaccagggcctgccaaggctgggtcctaacgggcctctgggtcatagcgcgccagtgcggccacgacgccttcagcgactac

SEQ ID NO: 35925 - DNA, 409 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttagttaccggataaggcgcagcggtcgggctgaacgggggtgtagatggcgccgtcgggcttcgaaagaactcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35926 - DNA, 305 bp, Artificial
  Mutation in BnaC.FAD2.b introduced by TALE nuclease pair BnFAD2_T03
caggatccatgggtgcaggtggaagaatgcaagtctctcctccctcccgctcccccggaaccaacaccctcaaacgcgtcccctgcgagacaccaccattcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctagcgggcctctgggtcatagcccacgagtgcggccaccacgccttcatcgactac

SEQ ID NO: 35927 - DNA, 317 bp, Artificial
  Mutation in BnaC.FAD2.b introduced by TALE nuclease pair BnFAD2_T03
caggatccatgggtgcaggtggaagaatgcaagtctatcctccctccagctccaccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcgcacgagttctgccaccacgccatcagcgactac

SEQ ID NO: 35928 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccatcagcgactac

SEQ ID NO: 35929 - DNA, 300 bp, Artificial
  Mutation in BnaC.FAD2.b introduced by TALE nuclease pair BnFAD2_T03
caggatccatgggtgcaggtggaagaatgcaagtctctcctccctacagctcccccgaaaccaaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35930 - DNA, 389 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttgctggcgatggccaccacctgctgggggggcaagccgtgggcccggcacagcaccggcaacagccgcaatcccacctcactgcttcaaacgctccatcccacgctccttctcctcttcgacatcatcatctcctcctcggctcctccctctcccacctccccacagcctacttccctctcccttacctcgcctgacccctctactgggcctgccaaggctgcgtcctgacgggcctctgggtcatagaccgcgagtgcggccaccacgccttcagcgactgc

SEQ ID NO: 35931 - DNA, 382 bp, Artificial
  Mutation in BnaC.FAD2.b introduced by TALE nuclease pair BnFAD2_T03
caggatccatgggtgcaggttgaagaatgcaagtctctcctccctccagctcccccggaaccaacaccctcaaacgcgtcccctgcgagacaccaccattcactactgacagaaccgcaacgttgaaggagccactcagccgcgggtttctgagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35932 - DNA, 319 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcatcatctcctcctcggctcctccctcaccctctctcctacttcgcctggcctctctactgggcctgccaagggtgcgtcctaacgggcctctgggtcatcgcccacgaatgcggccaccacgccttcagcgactac

SEQ ID NO: 35933 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagcggagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35934 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgccccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 35935 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35936 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctaagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 35937 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttacctcaagaaagcaatcccacctcactgcttcaaacgctccatccctcgctccttctcctacctcctcttcgccatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35938 - DNA, 349 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaatcctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgtcaaggctgcgtcctaacgggcctctaggtcatcgcccacgaatgcggccaccacgccttcatcgactac

SEQ ID NO: 35939 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtccactgcgagacaccaccattcactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35940 - DNA, 305 bp, Artificial
  Mutation in BnaC.FAD2.b introduced by TALE nuclease pair BnFAD2_T03
caggatccatgggtgcaggtggaagaatgcaagtctatcctccctccagctcccccggaaccaacaccctcaaacgcgtcccctgcgagacacaaccattcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35941 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccagggctgcgtcctaaccggcgtctgtgtcatagcccacgagtgcggccaccacgccttcagcgactac

SEQ ID NO: 35942 - DNA, 306 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctcggggtcatcgcccgcgaatgcggccaccacgccttcagcgactac

SEQ ID NO: 35943 - DNA, 407 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccatcaaacgcgtcccctgcgagacaccaccattcactcttgggcatggcacagcaccggcaacagccgctggaccgtctccagcgcctgcttgcgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35944 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35945 - DNA, 350 bp, Artificial
  Mutation in BnaC.FAD2.b introduced by TALE nuclease pair BnFAD2_T03
caggatacatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35946 - DNA, 382 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgggtcaagccgtgggcctggcacagcaccggcaagcaggcgctggagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35947 - DNA, 387 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttgaccccggagcaggtggtggccatcgccagccacgatggcggcaagcaggcgacctcaagaaagcaatcccacctcactgcttcaaacgctccatcccacgcgccttctcctcttcgacatcatcatctcctcctcggctcctccccctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35948 - DNA, 348 bp, Artificial
  Mutation in BnaC.FAD2.b introduced by TALE nuclease pair BnFAD2_T03
caggatccatgggtgcaggtggaagaatgcaagtctgtcctccctccagctcccccgaaaccaaaaccctcaaacgcgtcccctgcgagacaccacccttcactctacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccagggctgcgtcctaaccggcgtctgggtcatagcccacgagtgcggccaccacgccttcagcgactac

SEQ ID NO: 35949 - DNA, 278 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacatcacccttcactctcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35950 - DNA, 339 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35951 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctcggggtcatcgcccacgaatgcggccaccacgccttcagcgactac

SEQ ID NO: 35952 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35953 - DNA, 355 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35954 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcggcccctacaagaccgcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35955 - DNA, 351 bp, Artificial
  Mutation in BnaC.FAD2.b introduced by TALE nuclease pair BnFAD2_T03
caggatccatgggtgcatgtggaagaatgcaagtctctcctccctccagctcccccggaaccaacaccctcaaacgcgtcccctgcgagacaccaccattcactcttgacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35956 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35957 - DNA, 377 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactccgtccagcggctgttgccggtgttgtgcctggcggagacctcaagaaagcaatcccacctccctgcttcaaacgccccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35958 - DNA, 296 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35959 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgaccccactactgagcctgccaaggctgcgtcctaacgggcctctgggtcatagcccacgagtgcggccaccacgccttcagcgactac

SEQ ID NO: 35960 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35961 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 35962 - DNA, 337 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35963 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctagcccctctactgggcctgccaaggctgcgtcctaacgggcctctgggtcatcgcccacgaatgcggccaccacgccttcagcgactac

SEQ ID NO: 35964 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 35965 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 35966 - DNA, 343 bp, Artificial
  Mutation in BnaC.FAD2.b introduced by TALE nuclease pair BnFAD2_T03
caggatccatgggtgcaggtggaagaatgcaagtctgtcctccctccagctcccccggaaccaacaccctcaaacgcgtcccctgcgagacaccaccattcactcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctcacccctctactgggcctgccaaggctgcgtcctaacgggcctctgggtcatagcccacgattgcggccaccacgccttcagcgactac

SEQ ID NO: 35967 - DNA, 336 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35968 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35969 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 35970 - DNA, 313 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctccctgactcaaacgctccatcccaccctccttctcctcttcgacatcatcatctcctcctcgtctcctccctcaccctctctcctacttcgcctggcctctctactgggcctgccagggctgcgtcctaacgggcctctgggtcatagcccacgaatgcggccaccacgccttcagcgactac

SEQ ID NO: 35971 - DNA, 336 bp, Artificial
  Mutation in BnaC.FAD2.b introduced by TALE nuclease pair BnFAD2_T03
caggatccatgggtgcaggtggaagaatgcaagtctatcctccctcccgctcccccggaaccaacacactcaaacgcgtcccctgcgagacaccaccattcactctcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35972 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctacaacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35973 - DNA, 334 bp, Artificial
  Mutation in BnaC.FAD2.b introduced by TALE nuclease pair BnFAD2_T03
caggatccatgggtgcaggtggaagaatgcaagtgactcctccctccagctcccccggaaccaacaccctcaaacgcgtcccctgcgagacaccaccattcacgagacctcaagaaagcaatcccacctcactgcttcaaacgctccatcccacgctccttctcctcttcgccatcatcatctcctcctcggctcctccctctaccacctctccacagcctacttccctctcccttacctcgcctgacccctctactcggccggccaaggctgcgccctaacgggcctctgggtcatagcccacgagtgcggccaccacgccttcagcgactac

SEQ ID NO: 35974 - DNA, 333 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaacctcaaacgcgtcccctgcgagacaccaccattcactcacctcaagctagcaatcccacctcactccttcagacgctccatcccacgctccttctcctcttcgacatcctcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35975 - DNA, 393 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgttgtgaagcaacggcccggagggtggcgggcaggacgcccgccataaactgccggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35976 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35977 - DNA, 398 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccaccattcactcttcacgccagcaacgcggcctttttacggttcctggccttttgctggccttttgctcacatgtagacctcaagaaagcaatcccacctcactgcttcaaacgctccatcccacgctccttctcctcttcgacatcatcatctcctcctcggctcctccctctaccacctctccacagcctacttccctcgcccttacctcgcctgacccctctactgggcctgccaaggctgcgtcctaacgggcctctgggtcatagcccacgagtgcggccaccacgccttcagcgactac

SEQ ID NO: 35978 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatcccacgatccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35979 - DNA, 336 bp, Artificial
  Mutation in BnaC.FAD2.b introduced by TALE nuclease pair BnFAD2_T03
caggatccatgggtgcaggtggaagaatgcaagtctatcctccctccagctccaccgaaaccaaaaccctcaaacgcgtcccctgcgagacacaaccagagacctcaagaaagcaatcccacctcactgcttcaaacgctccatccctcgctccttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35980 - DNA, 309 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacacctcaagaaagcaatcccacctcactgcttcaaacgctccatcccacgctccttctcctcttcgacatcatcatctcctcctcggctcctccctcaccctctctcctacttcgcctggcctctctactgggcctgccaagggtgcgtcctaaccggcgtctgggtcatagcccacgagtgcggccaccacgccttcagcgactac

SEQ ID NO: 35981 - DNA, 286 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaagaaagcaatcccaccccactccttcaaacgctccatcccacgctccatctcctcttcgacatcatcatcccctcctcgactcccccctctaccacctctccacagcctacttccctctcccttacctcgcctgacccctctactgggcctgccaaggctgcgtcctaaccggcctctgggtcatcgcccacgaatgcggccaccacgccttcagcgactac

SEQ ID NO: 35982 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatggcccacgagtgcggccaccacgccttcagcgactac

SEQ ID NO: 35983 - DNA, 335 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35984 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35985 - DNA, 334 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccatcaaacgcgtcccctgcgagacaccaccatttcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagccctcgagttcggccaccacgccttcagcgactac

SEQ ID NO: 35986 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctaacccctctactgggcctgccaaggctgcgtcctaacgggcctctgggtcatagcccacgagtgcggccaccacgccttcagcgactac

SEQ ID NO: 35987 - DNA, 322 bp, Artificial
  Mutation in BnaC.FAD2.b introduced by TALE nuclease pair BnFAD2_T03
caggatccatgggtgcaggtggaagaatgcaagtctctccaccctgcagcccccccggaaccaacaccctcaaacgcgtcccctgcgagcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcggggtcatagcccacgagtgcggccaccacgccttcagcgactac

SEQ ID NO: 35988 - DNA, 464 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagcttgacggggaaagccggcgaacgtggcgagaaaggaagggaagaaagcgaaaggagcgggcgctaggtttagggttgcgatttagtgctttacggcacctcgaccccaaaagacctcaagaaagcaatcccacctcactgcttcaaacgctccatcccacgctccttctcctacctccccttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35989 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttatcaagaaagcaatcccacctcactgcttcaaacgctccatcccacgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35990 - DNA, 350 bp, Artificial
  Mutation in BnaC.FAD2.b introduced by TALE nuclease pair BnFAD2_T03
caggatcaatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccatcagcgactac

SEQ ID NO: 35991 - DNA, 325 bp, Artificial
  Mutation in BnaC.FAD2.b introduced by TALE nuclease pair BnFAD2_T03
caggatccatgggtgcaggtggaagaatgcaagtctctcctccctccagctccccggaaccaacaacctcaaacgcgtcccctgcgagacaccaccattcactctttaacaatcccacctcactgcttcaaacgctccatcccacgctccttctcctcttcgacatcatcatctcctcctcggctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 35992 - DNA, 327 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaccgcgtcccctgcgagacaccaccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcatcgactac

SEQ ID NO: 35993 - DNA, 350 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccagggctgcgtcctaaccggcgtctgggtcatagcccacgagtgcggccaccacgccttcagcgactac

SEQ ID NO: 35994 - DNA, 333 bp, Artificial
  Mutation in BnaC.FAD2.b introduced by TALE nuclease pair BnFAD2_T03
caggatccatgggtgcaggtggaagaatgcaagtgtctcctcccttcaaaaagtctgaaaccgacaacatcaagcgcgtaccctgcgagacaccgcccttcactgtcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagccctccagtgctgccaccacgccatcatcgactac

SEQ ID NO: 35995 - DNA, 279 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 35996 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 35997 - DNA, 338 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactactcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 35998 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggacccaacaccctcaaacgcgtcccctgcgagacaccaccattcactctcggaaagcaatcccacctcactgcttcaaacgctccatcccacgctccttctcctcttcgacatcatcatctcctcctcggctcctccctctaccacctctccacagcctacttccctctcccttacctcgcctgacccctctactcggcctgccaaggctgcgtcctaacggtcctctgggtcatagcccacgagtgcggccacgacgccctcagcgactac

SEQ ID NO: 35999 - DNA, 337 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactcggcctgccaaggctgcgtcctaacgggcctctgggtcatagcccacgagtgcggccaccacgccttcagcgactac

SEQ ID NO: 36000 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36001 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36002 - DNA, 264 bp, Artificial
  Mutation in BnaC.FAD2.b introduced by TALE nuclease pair BnFAD2_T03
caggatccagggtgcaggtggaagaatgcaagtctctcctccctccagtctctccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36003 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36004 - DNA, 274 bp, Artificial
  Mutation in BnaC.FAD2.b introduced by TALE nuclease pair BnFAD2_T03
caggatctatgggtgcaggtggaagaatgcaagtctatcctccctccagctcccccggaaccaacacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggcctccacgcctttatcgactgc

SEQ ID NO: 36005 - DNA, 371 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgccggtgctgtgccaggcccagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36006 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccccgcctggcccctctaccgggcctgccaaggctgcgtcctaacggtcctctgggtcatcgcccacgaatgcggccaccacgccttcgcgactac

SEQ ID NO: 36007 - DNA, 331 bp, Artificial
  Mutation in BnaC.FAD2.b introduced by TALE nuclease pair BnFAD2_T03
caggatccatgggtgcaggtggaagaatgcaagtctctcctccctaccgctcccccggaaccaacaccctcaaacgcgtcccctgcgagacaccaccattcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcttcttggtcatagaccacgagtgcggccaccacgccttcagcgactac

SEQ ID NO: 36008 - DNA, 325 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtatagaactcaagaaagcaatcccaccgcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36009 - DNA, 335 bp, Artificial
  Mutation in BnaC.FAD2.b introduced by TALE nuclease pair BnFAD2_T03
caggatccatgggtgcaggtggaagaatgcaagtccctccaccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcggggtcatagcccacgagtgcggccaccacgccatgagcgactac

SEQ ID NO: 36010 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36011 - DNA, 294 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcgcgactac

SEQ ID NO: 36012 - DNA, 347 bp, Artificial
  Mutation in BnaC.FAD2.b introduced by TALE nuclease pair BnFAD2_T03
caggatccatgggtgcaggtggacgcatgccagtctctcctccctccagttcccccgacaccaaaaccctcaaacgcgtcccctgcgcgacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgacgac

SEQ ID NO: 36013 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccagggctgcgtcctaacgggcctctgggtcatagcccacgagtgcggccaccacgccttcagcgactac

SEQ ID NO: 36014 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgagtgcggccaccacgccttcagcgactac

SEQ ID NO: 36015 - DNA, 276 bp, Artificial
  Mutation in BnaC.FAD2.b introduced by TALE nuclease pair BnFAD2_T03
caggatccatgggtgcaggtggaagaatgcaagtctctcctctcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36016 - DNA, 336 bp, Artificial
  Mutation in BnaC.FAD2.b introduced by TALE nuclease pair BnFAD2_T03
caggatccatgggtgcaggtggaagaatgcaagtctctcctcccttcagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36017 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacttagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 36018 - DNA, 334 bp, Artificial
  Mutation in BnaC.FAD2.b introduced by TALE nuclease pair BnFAD2_T03
caggatccatgggtgcaggtggaagaatgcaagtctctcctccctccagctccccggaaccaaaaacctaaaaccagtcccctgccggaccccaccattcaatgagacctcaagaaaacaatcccaactcactgcttcaaacgctccatccctcgctccttctccccttcgacatcatcatctcctcctcggctcctccctctaccacctctccacagcctacttccctctcccttacctcgcctgacccctctactgtgcctgccaaggctgcgtcctaacgggcctctgggtcatagcccacgagtgcggccaccacgccttcagcgactac

SEQ ID NO: 36019 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaacctcaagaaaacaatcccacctcaccgctccaaacgctccatcccacccccctctccctctccgacatcatcatctcctcctcggctccgccctctaccacctctccccaccctacttccctctcccttgcctcgcctggcccctctactgggcctgccaaggctgcgtcctaaccggcgtctgggtcatagcccacgagtgcggccaccacgccttcagcgactac

SEQ ID NO: 36020 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcacgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36021 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36022 - DNA, 350 bp, Artificial
  Mutation in BnaC.FAD2.b introduced by TALE nuclease pair BnFAD2_T03
caggatccatgggtgcaggtggaagaatgcaagtctcccctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccacgacgccttcagcgactac

SEQ ID NO: 36023 - DNA, 433 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccccagcaggcggtggccatcgccagcaataatggtggcaagcaggcgctggagacggtgctgtgccaggcccacggcttgaccccccagcaggcggtggccctcgccagcaaaactcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36024 - DNA, 335 bp, Artificial
  Mutation in BnaC.FAD2.b introduced by TALE nuclease pair BnFAD2_T03
caggatccatgggtgcaggtggaagaatgcaagtctctcctccctcccgctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36025 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgcgcctgccaaggctgcgtcctaacgggcctctgggtcatagcccacgagtgcggccaccacgccttcagcgactac

SEQ ID NO: 36026 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccgcctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36027 - DNA, 479 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacgctcactgcccgctttccagtcgggaaacctgtcgtgccagctgcattaatgaatcggccaacgcgcggggagaggcggtttgcggattgggggctcttccgcttcctcgcccactgactcgctgcgctcggagacctcaagaaagcaatcccacctcactgcttcaaacgctccacccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36028 - DNA, 349 bp, Artificial
  Mutation in BnaC.FAD2.b introduced by TALE nuclease pair BnFAD2_T03
caggatccatgggtgcaggtggaagattgcaagtctctcctccctccagctcccccgaaaccaaaaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccatcagcgactac

SEQ ID NO: 36029 - DNA, 336 bp, Artificial
  Mutation in BnaC.FAD2.b introduced by TALE nuclease pair BnFAD2_T03
caggatccatgggtgcaggtgcaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36030 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36031 - DNA, 352 bp, Artificial
  Mutation in BnaC.FAD2.b introduced by TALE nuclease pair BnFAD2_T03
caggatccatgggtgcaggtggaagaatgcaagtctctcctccctcccgctcccccggaaccaacaccatcaaacgcgtcccctgcgagacaccaccattcactctggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtccgaacgggcctctggggcatagccgacgagtgcggccaccacgccttcagcgactac

SEQ ID NO: 36032 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttacctctcctccctcaccctctctcctacttcgcctggcctctctactgggcctgccagggctgcgtcctaaccggcgtctgggtcatagcccacgagtgcggccaccacgccttcagcgactac

SEQ ID NO: 36033 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccaagagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 36034 - DNA, 305 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36035 - DNA, 334 bp, Artificial
  Mutation in BnaC.FAD2.b introduced by TALE nuclease pair BnFAD2_T03
caggatccatgggtgcaggtggaagaatgcaagtatctcctccctccagctcccccgaaaccaaaaccctcaaacgcgtcccctgcgagacaccacccttcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36036 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccatcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36037 - DNA, 371 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggaagagtttgtagaaacgcaaaaaggccatccgtcagacctcaagaaagcaatcccacctcactgcttcaaacgctccatcccacgctccttctcctcttcgacatcatcatctcctcctcggctcctccctctaccacctctccacagccttcttccctctcccttacctcgcctgacccctctactgggcctgccaaggctgcgtcctaacggtcctctgggtcatagcccacgagtgcggccaccacgccttcagcgactac

SEQ ID NO: 36038 - DNA, 333 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactgacctcaagaaagcaatcccacctcactgcttcaaacgctccatcccacgctccttctcctcttcgacatcatcatctcctcctcggctcctccctctaccacctctccacagcctacttccctctcccttacctcgcctgacccatctactgggcctgccaaggctgcgtcctaacgggcctctgggtcatagcccacgagtgcggccaccacgccttcagcgactac

SEQ ID NO: 36039 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36040 - DNA, 335 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccaacaccatcaagcgcgtaccctgcgagacaccgcccttcactgagaactcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36041 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgattgcggccaccacgccttcagcgactac

SEQ ID NO: 36042 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaacgcgtcccctgcgtgacaccaccattcacttagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctccgtcccaacgggcctctgggtcatagcccaccagtgcggccaccacgccttcagcgactac

SEQ ID NO: 36043 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctacgagacaccacccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36044 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36045 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 36046 - DNA, 399 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggctggcgatggccaccacctgctggggggtcaagccgtgggcctggcacagcaccggagaactcaagaaagcaatcccacctcactgcttcaaacgctccatccctcgctccttctcctcttcgacatcatcatctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 36047 - DNA, 282 bp, Artificial
  Mutation in BnaC.FAD2.b introduced by TALE nuclease pair BnFAD2_T03
caggatccatgggtgcaggtggaagaatgcaagtctctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgattgcggccaccacgccttcagcgactac

SEQ ID NO: 36048 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcatcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36049 - DNA, 274 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36050 - DNA, 399 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcccacggcttgaccccccagcaggtggtggccatcgccagcaatggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36051 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccctccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 36052 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36053 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttgcctcgcctggcccctctactgggcctgccaaggctgcgtcctaaccggcgtctgggtcatagcccacgagtgcggccaccacgccttcagcgactac

SEQ ID NO: 36054 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36055 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccatcagcgactac

SEQ ID NO: 36056 - DNA, 337 bp, Artificial
  Mutation in BnaC.FAD2.b introduced by TALE nuclease pair BnFAD2_T03
cagcatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36057 - DNA, 334 bp, Artificial
  Mutation in BnaC.FAD2.b introduced by TALE nuclease pair BnFAD2_T03
caggatccagggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 36058 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36059 - DNA, 363 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtccccctgcgagacaccacaccgcccgccataaactgccaggcatcaaacagcggagacctcaagaaagcaatcccacctcactgcttcaaacgctccatcccacgctccttctcctcttcgacatcatcatctcctcctcggctcctccctctaccacctctccacagcctactcccctctcccttacctcgcctgacccctctactgggcctgccaaggctgcgtcctaacgggcctctgtgtcatagcccacgagtgcggccaccacgccttcagcgactac

SEQ ID NO: 36060 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36061 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccatgctccttaagaaagcaatcccacatcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36062 - DNA, 416 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagcgcctgctgccggtgctgtgccaggcccacggcttgaccccccagcaggtggtggccatcgccagcaataatggtggcagacctcaagaaagcaatcccacctcactgcttcaaacgctccatcccacgctctttctcctcttcgacatcatcatctcctcctcggctcctccctctaccacctctccacaacctacttccctctcccttacctcgcctgacccctctactgggcctgccaaggctgcgtcctaacgggcctctgggtcatagcccacgagtgcggccaccacgccttcagcgactac

SEQ ID NO: 36063 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36064 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36065 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatatcccacgagtgcggccaccacgccttcagcgactac

SEQ ID NO: 36066 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaaacaatcccacctcactgcttcaaacgctccatcccacgctccttctcctcttcgacatcatcatctcctcctcggctcctccctctaccacctctccacagcctacttccatctcccttacctcgcctgacccctctactgggcctgccaaggctgcgtcctaacgggcctctgggtcatagcccacgagtgcggccaccacgccttcagcgactac

SEQ ID NO: 36067 - DNA, 389 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttgctggcgatggccaccacctgctggggggtcaagccgtgggcctggcacagcaccggcaacagccgcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgcccttcagcgactac

SEQ ID NO: 36068 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactctcggcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 36069 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgctgccaccacgccttcagcgactac

SEQ ID NO: 36070 - DNA, 328 bp, Artificial
  Mutation in BnaC.FAD2.b introduced by TALE nuclease pair BnFAD2_T03
caggatccatgggtgcaggtggaagaatgcaagtctctcctacctccagctcccccggaaccaacaccatcaaacgcgtcccctgcgagacaccaccattcactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 36071 - DNA, 306 bp, Artificial
  Mutation in BnaC.FAD2.b introduced by TALE nuclease pair BnFAD2_T03
caggatccatgggtgcaggtggaagaatgcaagtccatcctccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgtgtcctaacgggcctctgggtcatcgcccacgtatgcggccaccacgccttcaccgactac

SEQ ID NO: 36072 - DNA, 386 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggggtcaagccgtgggcctggcacagcaccggcaacagccgctggaccgagacctcaagaaagcaatcccacctcactgcttcaaacgctccatcccacgccccttctcctcttcgacatcatcatctcctcctcggctcctccctctcccacctccccacagcctacttccctctcccttacctcgcctgacccctctactgggcctgccaaggctgcgtcctaacgggcctctgggtcatagcccacgagtgtggccaccacgccttcagcgactac

SEQ ID NO: 36073 - DNA, 370 bp, Artificial
  Mutation in BnaC.FAD2.b introduced by TALE nuclease pair BnFAD2_T03
caggatccatgggtgcaggtggaagaatgcaagtgtctcctccctcccagaagtctgaaaccgacaccatcaagcgcgtaccctgcgagacaccaccattcactccgtccagcggctgttgccggtgttgtgcctggcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcttggtcatatcccacgagtgcggccaccacgccttcagcgactac

SEQ ID NO: 36074 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcttggtcatagcccacgagtgcggccaccacgccttcagcgactac

SEQ ID NO: 36075 - DNA, 336 bp, Artificial
  Mutation in BnaC.FAD2.b introduced by TALE nuclease pair BnFAD2_T03
caggatccatgggtgcaggtggaagaatgcaagtctctcctccttccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36076 - DNA, 351 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccatcaaacgcgtcccctgcgagacaccaccattcactctgagacctcaagaaagcaatcccaccgcactccttcaaacgctccatccctcgctctttctcctacctcccctgcgacatctccacctcctcctccctctaccacccctccacagcctacttccctctcctcccccaccctctcccctacctcgcctggcccctctactgggcctgccaaggctgcgtcctaacgggcctctgggtcatcgcccacgaatgcggccaccacgccttcagcgactac

SEQ ID NO: 36077 - DNA, 347 bp, Artificial
  Mutation in BnaC.FAD2.b introduced by TALE nuclease pair BnFAD2_T03
caggtccatgggtgcagtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 36078 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36079 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36080 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36081 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactcc

SEQ ID NO: 36082 - DNA, 471 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtccactgcgagacaccaccattcactcttgccggtgctgtgccaggcccacggcttgaccccccagcaggtggtggccatcgccagcaatggcggtggcaacagccgctggaccgttgccggtgctgtgccaggcccacggcttgcccccccagcaggtggtgagaccccaagaaagcaatcccacctcactgcttcaaacgctccaccccacgctccttctcctcttcgacaccatcatctcctcctcggctcctccctctaccacctctccccagcctacttccctctcccttacctcgcctgacccctctactgggcctgccaaggctgcgtcctaacgggcctctgggtcatagcccacgagtgcggccaccacgccttcagcgactac

SEQ ID NO: 36083 - DNA, 376 bp, Artificial
  Mutation in BnaC.FAD2.b introduced by TALE nuclease pair BnFAD2_T03
caggatccatgggtgcaggtgaaagaatgcaagtctctcctccctccagctcccccggaaccaacaccctcaaacgcgtcccctgcgagacaccaccattcacttccgtgggcctggcacagcaccggcaacagccgctggagacgagacctcaagaaagcaatcccacctcactgcttcaaacgctccatcccacgctccttctcctcttcgacatcatcatctcctcctcggctcctccctctaccacctctccacagccttcttccctctcccttacctcacctgacccctctactgggcctgccaaggctgcgtcctaacgggcctctgggtcatagcccgcgagtgcggccaccacgccatcagcgactac

SEQ ID NO: 36084 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgatttcggccaccacgccttcagcgactac

SEQ ID NO: 36085 - DNA, 281 bp, Artificial
  Mutation in BnaC.FAD2.b introduced by TALE nuclease pair BnFAD2_T03
caggatccatgggtgcaggaggaagaatgcaagtgtctcctccctccagctcccccgaaaccaaaaccctccacctcactgcttcaaacgctccatcccacgctccttctcctcttcgacatcatcatctcctcctcggctcctccctctaccacctctccacagcctacttccctctcccttacctcgccttacccctctactgggcctgccaaggctgcgtcctaacgggcctctgggtcatagcccacgagtgcggccaccacgccttcagcgactac

SEQ ID NO: 36086 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36087 - DNA, 426 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggaagactgagcctttcgttttatctgttgtttgtcggtgaacgctctcctgagtaggacaaatccgccgggagcggatttgaacgttgtgagacctcaagaaagcaatcccacctcactgcttcaaacgctccatcccacgctccttctcctcttcgacatcatcaccccctcctcggctcctccctctcccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 36088 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactcacctcaagaaagcaatcccacctcactgcttcaaacgctccatcccacgctccttctcctcttcgacatcatcatctcctcctcggctcctcctccctctagcacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36089 - DNA, 324 bp, Artificial
  Mutation in BnaC.FAD2.b introduced by TALE nuclease pair BnFAD2_T03
caggatccatgggtgcaggtggaagaatgcaagtctctcctccaccaacaccctcaaacgcgtcccctgcgagacaccaccattcactctcgggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36090 - DNA, 420 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggtgttgtgccaggcccacggcttgaccccggagcaggtggtggccatcgccagccacgatggcggcaacagccgctggacccagacctcaagaaagcaatcccacctcactgcttcaaacgctccatcccacgctccttctcctcttcgacatcatcacctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36091 - DNA, 334 bp, Artificial
  Mutation in BnaC.FAD2.b introduced by TALE nuclease pair BnFAD2_T03
caggatccatgggtgcaggtggaagaatgcaagtctatcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36092 - DNA, 305 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36093 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 36094 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36095 - DNA, 324 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccatcaaacgcgtcccctgcgagacctcaagaaagcaatcccacctcactgcttcaaacgctccatccctcgctccttctcctcttcgacatcctcgtctcctcctccctctaccacctctccacagcctacttccctctccccccccaccctctcccttacctcgcctggcccctctactgggcctgccaaggctgcgtcctaacgggcctctgggtcatcgcccacgaatgcggccaccacgccttcagcgactac

SEQ ID NO: 36096 - DNA, 334 bp, Artificial
  Mutation in BnaC.FAD2.b introduced by TALE nuclease pair BnFAD2_T03
caggatccatgggtgcaggtggaagaatgcaagtctctcctccatccagctcccccgaaaccaaaaccctcaaacgcgtcccctgcgagacaccaccattcactccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36097 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacccctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 36098 - DNA, 321 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacacacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36099 - DNA, 394 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgccggtgctgtgccaggcccacggcttgaccccccagcaggtggtgggaactcaagatagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36100 - DNA, 427 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccgtccagcggctgttgccggtgctgtgccaggcccacggcttgaccccggagcaggtggtggccatcgccagccacgatggcggcaagcaggcgctggagagagacctcaagaaagcaatcccacctcactgcttcaaacgctccatccctcgctccttctcctacctcctcttcgacatcctcgtctcctcctccctctcccacctctccacagcctacttccctctcccttacctcgcctggcctctctactgggcctgccagggctgcgtcctaaccggcgtctgggtcatagcccacgagtgcggccaccacgccttcagcgactac

SEQ ID NO: 36101 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgtcaaggctgcgtcctaacgggcctctgggtcatagcccacgagtgcggccaccacgccttcagcgactac

SEQ ID NO: 36102 - DNA, 432 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcctggagacggtccagcggctgttgccggtgctgtgccaggcccacggcttgaccccggagcaggtggtggccatcgccagccacgatggcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccttccaaggctgcgtcctaacgggcctctgggtcatcgcccacgaatgcggccaccacgccttcagcgactac

SEQ ID NO: 36103 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaacgggcctctgggtcatcgcccacgaatgcggccaccacgccttcagcgactac

SEQ ID NO: 36104 - DNA, 388 bp, Artificial
  Mutation in BnaC.FAD2.b introduced by TALE nuclease pair BnFAD2_T03
caggatccatgggtgcaggcggaagaatgcaagtctctcctccctccagctcccccgaaaccaaaaccctcaaacgcgtcccctgcgagacaccacccttcactctcggctgttgccggtgctgtgccaggcccacggcttgaccccccagcaggtggagacctcaagaaagcaatcccacctcactgcttcaaacgctccatcccacgctccttatcctcttcgacatcatcatctcctcctcggctcctccctctaccacctcttcacagcctccttccctctcccttacctcgcctgacccctctactgggcctgccaaggctgcgtcctaacggacctctgggtcatagcccacgagtgcggccaccacgccatcagcgactac

SEQ ID NO: 36105 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcttggtcatcgcccacgaatgcggccaccacgccttcagcgactac

SEQ ID NO: 36106 - DNA, 340 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctcgggagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 36107 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36108 - DNA, 351 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36109 - DNA, 337 bp, Artificial
  Mutation in BnaC.FAD2.b introduced by TALE nuclease pair BnFAD2_T03
caggatccatgggtgcaggtcgaagaatgcaagtctctcctcaatccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcgtccaccacgccttcagcgactac

SEQ ID NO: 36110 - DNA, 329 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccaccatagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcggcctaacgggcctctgggtcatagcccacgagtgcggccaccacgccttcagcgactac

SEQ ID NO: 36111 - DNA, 334 bp, Artificial
  Mutation in BnaC.FAD2.b introduced by TALE nuclease pair BnFAD2_T03
caggatccatgggtgcaggtggaagaatgcaagtctctcctccctcccgctcccccgaaaccaaaaccctcaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtcctaacgggcctctgggtcatagcccacgagtgcggccaccacgccatcagcgactac

SEQ ID NO: 36112 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36113 - DNA, 333 bp, Artificial
  Mutation in BnaC.FAD2.b introduced by TALE nuclease pair BnFAD2_T03
caggatccatgggtgcaggtggaagaatgcaagtctctcctccctccaaaaagtctgaaaccgacaacatcaagcgcgtacccagcgagacaccgcccttcactgaactcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36114 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 36115 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36116 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcatccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36117 - DNA, 336 bp, Artificial
  Mutation in BnaC.FAD2.b introduced by TALE nuclease pair BnFAD2_T03
caggatccatgggtgcaggtggaagaatgcaagtctctcctccctcccgctcccccggaaccaacaccctcaaccgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgtgcctgccaaggctgcgtcctaacggtcctctgggtcatcgcccacgaatgcggccaccacgccttcagcgactac

SEQ ID NO: 36118 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctccctcaccctctctcctccttcgcctggcctctctactgggcctgccaagggtgcgtcctaaccggcgtctgggtcatagcccacgagtgcggccaccacgccttcagcgactac

SEQ ID NO: 36119 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36120 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcatccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36121 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctacggggcctgccaaggctgcgtcctaacgggcctctgggtcatcgcccacgaatgcggctaccacgccttcagcgactac

SEQ ID NO: 36122 - DNA, 411 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgccagccacgatggcggcaagcaggcgctggagacggtccagcggctgttgccggtgctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36123 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagtccacgagtgcggccaccacgccttcagcgactac

SEQ ID NO: 36124 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 36125 - DNA, 376 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacacccgcttcctcgctcactgactcgctgcgctcggtcgttcggctgcggcgagcggagaactcaagaaagcaatcccaccgcactgtttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36126 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36127 - DNA, 404 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattccggatggcctttttgcgtttctacaaactcttcctggctagcggtacgcgtattaattgcgttgcgagacctcaagaaagcaatcccacctcactgcttcaaacgctccatcccacgctccttctcctcttcgacatcatcatctcctcctccctctaccacctctccccagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 36128 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36129 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactcggcctgccaaggctgcgtcctaacgggcctctgggtcatagcccacgagtgcggccaccacgccttcagcgactac

SEQ ID NO: 36130 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccctgacctcaagaaagcaatcccacctcactgcttcaaacgctccatccctcgctccttttcctacctcctcttcgacatcctcgtctcctcctccctctaccacctctccacagcctacttccctctcctcccccaccctctcccttacctcgcctggcccctctactgggcctgccaaggctgcgtcctaacggacctctgggtcatcgcccacgaatgcggccaccacgccttcagcgactac

SEQ ID NO: 36131 - DNA, 291 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36132 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgccagacctcaagaaagcaatcccacctcactacttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36133 - DNA, 342 bp, Artificial
  Mutation in BnaC.FAD2.b introduced by TALE nuclease pair BnFAD2_T03
caggatccatgggtgcaggtggaagaatgcaagtctctcctccaccccgctcccccggaaccaacaccctcaaacgcgtcccctgcgagacaccaccattcactcagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctagccggcgtcgtggtcatagcccacgagtgcggccgctacgccttcatcgactac

SEQ ID NO: 36134 - DNA, 403 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctaaaaaccaaaatagcgagaggcttttgcaaaagaagttttgccagagggggtaatagtaaaatgtttagacctcaagaaagcaatcccacctcactgcttcaaacgctccatcccacgctccttctcctcttcgacatcatcatctcctcctcggctcctccctctaccacctctccacagcctacttccctcgcccttacctcgcctgacccctctactgggcctgccaaggctgcgtcctaacgggcctctgggtcatagcccacgagtgcggccaccacgccttcagcgactac

SEQ ID NO: 36135 - DNA, 385 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgaggcttgttgtgaagggattccaacaaaaagtaggcgagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36136 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccagagctgcgtcctaaccggcgtctgggtcatagcccacgagtgcggccaccacgccatcagcgactac

SEQ ID NO: 36137 - DNA, 346 bp, Artificial
  Mutation in BnaC.FAD2.b introduced by TALE nuclease pair BnFAD2_T03
caggatccatgggtgcaggtggaagaatgcaagtctctcccccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccacccgctcccttacctcgccgggcccctctactgggcgcgccaaggctgcgtccgaacgggcctctgggtcatcgcccacgaatgcggccaccacgccttgagcgactac

SEQ ID NO: 36138 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36139 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccatcaaacgcgtcccctgcgagacaccaccattcactctcctcaagaaagcaatcccacctcactgcttcaaacgctccatcccacgctccttctcctcttcgacatcatcatctcctcctcggctcctccctctaccacctcaccacagcctacttccctctcccttacctcgcctgacccctctactgggcctgccaaggctgcgtcctaacgggcctctgggtcatagcccacgagtgcggccaccacgccttcagcgactac

SEQ ID NO: 36140 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccctgacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36141 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagaccccaccattcacttagacctcaagaaagcaatcccacctcactgcttcaaacgctccatcccacgctccttctcctcttcgacatcatcatctcctcctcggctcctccctctaccacctctccacagcctacttccctctcccttccctcgcctgtcccctctacggggcgtgccaaggctgcgtcctaacgggcctctgtgtcatcgcccacgaatgcggcgaccacgccatgagcgacgac

SEQ ID NO: 36142 - DNA, 451 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagggggtcaagccgtgggcctggcacagcaccggcaacagccgctggacgaagactgggcctttcgttttatctgttgtttgtcggtgaacgctctcctgagtaggacaaatccggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36143 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36144 - DNA, 358 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggatcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36145 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 36146 - DNA, 349 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaccatcaaacgcgtcccctgcgagacaccacccttcactgagacctcaagaaagcaatcccacctcactgcttcaaacgctccatccctcgctccttctcctacctcctcttcgacatcctcgtctcctcctccctataccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 36147 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaagggtgcgtcctaaccggcgtctgggtcatagcccacgagtgcggccaccacgccttcagcgactac

SEQ ID NO: 36148 - DNA, 350 bp, Artificial
  Mutation in BnaC.FAD2.b introduced by TALE nuclease pair BnFAD2_T03
caggatccatgggtgcaggtggcagaatgcaagtgtctcctccctccaagaagtctgaaaccgacaccatcaagcgcgtaccctgcgagacaccacccttcactctcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgcctcagcgactac

SEQ ID NO: 36149 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36150 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36151 - DNA, 348 bp, Artificial
  Mutation in BnaC.FAD2.b introduced by TALE nuclease pair BnFAD2_T03
caggatccatgggtgcaggtggaagaatgcaagtgactcctccctccaagaagtctgaaaccgacaccatcaagcgcgtaccctgcgagacaccgcccttcactgtaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36152 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctaaaacgcgtcccctgcgagacacctacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacggggctctgggtcatcgcccacgaatgcggccaccacgccttcagcgactac

SEQ ID NO: 36153 - DNA, 326 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtacggctgcggcgagcggagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36154 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36155 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatgctccttaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36156 - DNA, 396 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggttcctggccttttgctggccttttgctcacatgttctttccggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36157 - DNA, 346 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactctgtagagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36158 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36159 - DNA, 328 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36160 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36161 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaccctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 36162 - DNA, 444 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctctccgatttagagcttgacggggcaagccggcgaacgtggcgagaaaggacgggaagaaagcgcaagcagcgggcgctcgggcgctggcaagtgtagcggttacgcgcagacctcaagacagcaatcccacctcactgcttccaacgctccatcccacgctccttctcctcttcgacagcatcacctcctcctcggctcctccctctaccacctctccacagcctacttccctcgcccttacctcgcctgacccctctactgggcctgccaaggctgcgtcctaacgggcctctgggtcatcgcccacgaatgcggccaccacgccttcagcgactac

SEQ ID NO: 36163 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36164 - DNA, 333 bp, Artificial
  Mutation in BnaC.FAD2.b introduced by TALE nuclease pair BnFAD2_T03
caggatccatgggtgcaggtggaagaatgcaagtctatcctccctccagctcccccggaaccaacaccctcaaacgcgtcccctgcgagacaccacccttcactgacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 36165 - DNA, 405 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgcaattaatacgcgtaccgctagccaggaagagtttgtagaaacgcaaaacggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36166 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36167 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36168 - DNA, 309 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36169 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36170 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36171 - DNA, 332 bp, Artificial
  Mutation in BnaC.FAD2.b introduced by TALE nuclease pair BnFAD2_T03
caggatccatgggtgcaggtggaagaatgcaagtctctcctcccccccgctcccccggaaccaacacactcaaccgcgtcccctgcgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctcggggtcatcgcccacgaatgcggccaccacgccttcagcgactac

SEQ ID NO: 36172 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggatcggagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36173 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccgaggctgcgtcctaacgggcctctgggtcatcgcccacgaatgcggccaccacgccttcagcgactac

SEQ ID NO: 36174 - DNA, 435 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccgtccagcggctgttgccggtgctgtgccaggcccacggcttgaccccggagcaggtggtggccatcgccagccacgatggcggcaagcaggcgctggagagagacctcaagaaagcaatcccacctcactgcttcaaacgctccatccctcgctccttctcctccctcctcttcgacatcctcgtctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36175 - DNA, 415 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcggagacggtccagcggctgttgccggtgctgtgccaggcccacggtccagcgcctgcttgccggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36176 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgacctcaagaaagcaatcccacctcactgcttcaaacgctccatcccacgctccttctcctcttcgacatcatcatctcctcctcgactcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 36177 - DNA, 354 bp, Artificial
  Mutation in BnaC.FAD2.b introduced by TALE nuclease pair BnFAD2_T03
caggatccatgggtgcaggtggaagaatgtaagtctctcctccctccagctcccccgaaaccaaaaccctcaaacgcgtcccctgcgagacaccacccttcactctcgggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaaggctgcgtcctaacgggcctctgggtcatagcccacgagtgcggccaccacgccttcagcgactac

SEQ ID NO: 36178 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36179 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36180 - DNA, 344 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36181 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccacccttcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36182 - DNA, 342 bp, Artificial
  Mutation in BnaC.FAD2.b introduced by TALE nuclease pair BnFAD2_T03
catccatgggtgcaggtggaagaatgcaagtctctcctccctccagctcccccgaaaccaaaaccctcaaacgcgtcccctgcgagacaccaccctggcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36183 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcaagaaagcaatcccacctcactgcttcaaacgctccatcccacgctccttctcctcttcgccatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36184 - DNA, 339 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactacctcaagaaagcaatcccacctcactgcttcaaacgctccatcccacgctccttctcctcttcgacatcatcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 36185 - DNA, 343 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtacactgcgagacacctccctccaagtgtctcctccctcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36186 - DNA, 341 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactagaactcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36187 - DNA, 454 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcttgaccccccagcaggtggtggccatcgccagcaataatggtggtaagaaggtcttggagacggtccagcggctgtttaaccgctcgccgcagccgaacgaccgagcgcagcgagtcagtgagcgaggaagctatcccacctcactgctccaaacgctccatcccacgctccttctcctcttcgacatcatcatctcctcctcgtctcctccctctcccacctctccacagcctacttccctctcccttccctcgcctgacccctctactgggcctgccaaggctgcgtcctaacgggcctctgggtcatagcccacgagtgcggccaccacgccttcagcgactac

SEQ ID NO: 36188 - DNA, 371 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacacttcactctcgctggtgctgtgccaggcccagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36189 - DNA, 330 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactctcgggaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36190 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 36191 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccatcagcgactac

SEQ ID NO: 36192 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36193 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcccctggcccctctactgggcctgccaaggctgcgtcctaacgggcctctgggtcatcgcccacgaatgcggccaccacgccttcagcgactac

SEQ ID NO: 36194 - DNA, 279 bp, Artificial
  Mutation in BnaC.FAD2.b introduced by TALE nuclease pair BnFAD2_T03
caggatccatgggtgcaggtggaagaatccaagtctctcctccctccagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcttcctaacgggcctctgggtcatcgcccacgaatgcggccaccacgccttcagcgactac

SEQ ID NO: 36195 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccctacctcgcctggcccctctactgggcctgccaaggctgcgtcctaacgggcctctgggtcatcgcccacgaatgcggccaccacgccttcagcgactac

SEQ ID NO: 36196 - DNA, 350 bp, Artificial
  Mutation in BnaC.FAD2.b introduced by TALE nuclease pair BnFAD2_T03
caggatccatgggtgcaggtggaagaatgcaagtctttcctccctccagctcccccggaaccaacaccctcaaacgcgtcccctgcgagacaccaccattcactcgagacctcaagaaagcaatcccaccgcactgtttcaaacgctctatccctcgctccttctcctacctcctcttcgacatcctcgtctcctcctccctctaccacctctccacagcctacttccctctactcccccaccctctcccttccctcgccaagcccctctactgggcctgccaagactgcgtcctaacgggcctctgggtcatcgcccacgaatgctgccaccgcgccttcagcgactcc

SEQ ID NO: 36197 - DNA, 348 bp, Artificial
  Mutation in BnaC.FAD2.b introduced by TALE nuclease pair BnFAD2_T03
caggatccatgggtgcaggtggaagaatgcaggtgtctcctccatccaagaagtctgaaaccgacaccatcaagcgcgtaccctgcgagacaccgcccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcccctggcccctctactgggcctgccaaggctgcgtcctaacgggcctctgggtcatcgcccacgaatgcggccaccacgccttcagcgactac

SEQ ID NO: 36198 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacaccatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36199 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatccctcgctccttctcctacctcctcttcgacatcctcgtctcctcctccctctatcacctctccacagcctacttccctctcctcccccaccctctcccttacctcgcctggcccctctactgggcctgccaaggctgcgtcctaacgggcctcggggtcatcgcccacgaatgcggccaccacgcctgcatcgactac

SEQ ID NO: 36200 - DNA, 343 bp, Artificial
  Mutation in BnaC.FAD2.b introduced by TALE nuclease pair BnFAD2_T03
caggatccatgggtgcaggtcgcagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36201 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcacctcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36202 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatactcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36203 - DNA, 335 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36204 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcacgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccaagaatgcggccaccacgccttcagcgactac

SEQ ID NO: 36205 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatccaacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36206 - DNA, 397 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagcaggtggtggccatcgccagccacgatggcggcaagcaggcgctggagaactcaagaaagcaatcccaccgcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36207 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaaccccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 36208 - DNA, 341 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccgaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36209 - DNA, 346 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactccatcccacgctccttctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36210 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcagacctcaagaaagcaatccctcctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 36211 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacctcaagaaagcaatcccacctaactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcttggtcatagcccacgagtgcggccaccacgccttcagcgactac

SEQ ID NO: 36212 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgactcctctactgggcctgccaaggctgcgtcctaacgggcctctgggtcatagcccacgagtgcggccaccacgccttcagcgactac

SEQ ID NO: 36213 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccatcaaacgcgtcccctgcgagacaccacccttcactctcgaactcaagaaagcaatcccacctcactgcttcaaacgctccatcccaccctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36214 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcactac

SEQ ID NO: 36215 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36216 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 36217 - DNA, 275 bp, Artificial
  Mutation in BnaC.FAD2.b introduced by TALE nuclease pair BnFAD2_T03
caggatctatgggtgcagggggaagaatgcaagtctctccccccggcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgaatggtgccaccatgcctcagcgactac

SEQ ID NO: 36218 - DNA, 275 bp, Artificial
  Mutation in BnaC.FAD2.b introduced by TALE nuclease pair BnFAD2_T03
caggatccatgggtgcaggtggaagaatgcaagtctctcctctcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgaatgcggccaccacgcctcagcgactac

SEQ ID NO: 36219 - DNA, 293 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36220 - DNA, 349 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 36221 - DNA, 335 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36222 - DNA, 334 bp, Artificial
  Mutation in BnaC.FAD2.b introduced by TALE nuclease pair BnFAD2_T03
caggatccatgggtgaaggtggcagaatgcaagtctctcctccctccagctcccccggaaccaacaccctcaaacacgtcccctgcgagacaccaccattcactcaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36223 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36224 - DNA, 337 bp, Artificial
  Mutation in BnaC.FAD2.b introduced by TALE nuclease pair BnFAD2_T03
caggatccatgggtgcaggtggcagaatgcaagtatctactccctccagctcccccggaaccaacaccctcaaacgcgtcccctgcgagacaccacccttcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcgtccaccacgccttcagcgactac

SEQ ID NO: 36225 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36226 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacttaaccccaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtcctaacgggcctcggggtcatagcccacgagggcggccaccacgccggcagcgactac

SEQ ID NO: 36227 - DNA, 349 bp, Artificial
  Mutation in BnaC.FAD2.b introduced by TALE nuclease pair BnFAD2_T03
caggatccatgggtgcaggtggcagaatgcaagtctctcctccctcccgctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36228 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 36229 - DNA, 334 bp, Artificial
  Mutation in BnaC.FAD2.b introduced by TALE nuclease pair BnFAD2_T03
caggatccatgggtgcaggcggaagaatgcaagtctctcctccctccagctcccccggaaccaacacccacaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctagcgggcctctgggtcatcgcccacgaatgcggccaccacgccttcagcgacta

SEQ ID NO: 36230 - DNA, 350 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36231 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctacaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36232 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 36233 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 36234 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36235 - DNA, 475 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctctccagcgcctgcttgccgccatcgtggctggcgatggccaccacctgctccggggtcaagccgtgggcctggcacagcaccggcaagcaggcgctggagacggtccagcggctgttgccgccagagacctcaagaaagcaatcccacctcactgcttcaaacgctccatccctcgctccttctcctacctcctcttcgacatcctcgtctcctcccccctctaccacctctccacagcctacttccctctcctcccccaccctctcccttagctcgcctggcccctctactgggcctgccaaggctgcgtcctaacgggcctctgggtcatcgcccacgaatgcggccaccacgccttcagcgactac

SEQ ID NO: 36236 - DNA, 335 bp, Artificial
  Mutation in BnaC.FAD2.b introduced by TALE nuclease pair BnFAD2_T03
caggatccatggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36237 - DNA, 332 bp, Artificial
  Mutation in BnaC.FAD2.b introduced by TALE nuclease pair BnFAD2_T03
caggatccatggtgcaggtggaagaatgcaagtctctcctccctccagctcccccgaaaccaaaaccctcaaacgcgtcccctgcgagacaccaccattcactaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36238 - DNA, 302 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36239 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36240 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36241 - DNA, 347 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacacgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36242 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtccccgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36243 - DNA, 328 bp, Artificial
  Mutation in BnaC.FAD2.b introduced by TALE nuclease pair BnFAD2_T03
caggatccatgtgtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36244 - DNA, 351 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctcagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 36245 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagaccccaagaaagcaatcccacctcactgcttcaaacgctccatcccccgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36246 - DNA, 313 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgttatcgagacctcaagaaagcaatcccacctcactgcttcaaacgctccatcccacgctccttctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36247 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatccctcgccccttctcctacctcctcttcgacatcctcgtctcctcctccctctaccacctctccacagcctacttccctctcctcccccaccctctcccttacctcgcctggcccctctactgggcctgccagggctgcgtcctaaccggcctctgggtcatcgcccacgaatgcggccaccacgccttcagcgactac

SEQ ID NO: 36248 - DNA, 344 bp, Artificial
  Mutation in BnaC.FAD2.b introduced by TALE nuclease pair BnFAD2_T03
caggatccatgggtgcaggtggaagaatgcaagtctctcctccatcccgctcccccggaaccaacaccctcaaacgcgtcccctgcgagacaccaccattcacttggagacctcaagaaagcaatcccacctcactgcttcaaacgctccatcccacgctccttctcctcttcgacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaaggcggccaccacgccttcagcgactac

SEQ ID NO: 36249 - DNA, 347 bp, Artificial
  Mutation in BnaC.FAD2.b introduced by TALE nuclease pair BnFAD2_T03
caggatccatgggtgcaggtggcagaatgcaagtgtctcctccctccagctcccccggaaccaacaccatcaaacgcgtcccctgcgagacaccaccattcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctccactggtcctgccaaggctgcgtcctaacgggcctctgggtcatcgcccacgaatgcggccaccacgccttcagcgactac

SEQ ID NO: 36250 - DNA, 291 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgaactcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 36251 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttgacctcaagaaagcaatcccacctcactgcctcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 36252 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36253 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaacaaacaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 36254 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgacctcaagaaagcaatcccacctcactgcttcaaacgctccatcccacgctccttctcctaactcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36255 - DNA, 331 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36256 - DNA, 337 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcacctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgagtgcggccaccacgccttcagcgactac

SEQ ID NO: 36257 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttagaactcaagaaagcaatcccaccgcactgcttcaaacgctccatccctcgctccttctcctacctcctcttcgacatcctcgtctcctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 36258 - DNA, 314 bp, Artificial
  Mutation in BnaC.FAD2.b introduced by TALE nuclease pair BnFAD2_T03
caggatccatgggtgcaggtggaagaatgcaagtctctcctccctccagctcccacgaaaccaaaaccctcaaacgcgtcccctgcgagacaccacccttcactccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36259 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccctgaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36260 - DNA, 324 bp, Artificial
  Mutation in BnaC.FAD2.b introduced by TALE nuclease pair BnFAD2_T03
caggatccatgggtgcaggtggaagaatgcaagtctctcctccctcccgctcccccggacccaacaccctcaaacgcgtcccctgcgagacaccaccattcaagaaagcaatcccacctcactgcttcaaacgctccatcccacgctccttctcctcttcgacatcatcatctcctcctcggctcctccctctaccacctctccacagccttcttccctctcccttacctcgcctgacccctctactgggcctgccaaggctgcgtcctaacgggcctctgggtcatcgcccacgaatgcggccaccacgccttctgcgactac

SEQ ID NO: 36261 - DNA, 335 bp, Artificial
  Mutation in BnaC.FAD2.b introduced by TALE nuclease pair BnFAD2_T03
caggatccatgggtgcaggtggcagaatgcaagtgtctcctccctcaagctcccccgaaaccaaaaccctcaaacgcgtcccctgcgagacaccaccattcactgagaccacaagaaagcaatcccacctcactgcttcaaacgctccatcccactctccttctcctcttcgacatcatcatctcctcctcggctcctccctctaccacctctccacagcctacttccctctcccttacctcgcctgacccctctactgggcctgccaaggctgcgtcctaacgggccgctggggcatcgcccacgaatgcggccaccacgccatcagcgactac

SEQ ID NO: 36262 - DNA, 331 bp, Artificial
  Mutation in BnaC.FAD2.b introduced by TALE nuclease pair BnFAD2_T03
caggatccatgggcgcaggtggaagaatgcaagtctctcctccctccagctcccccggaaccaacaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctagcgggcctcttggtcatcgcccacgaatgcggccacctcgcctgcagcgactac

SEQ ID NO: 36263 - DNA, 336 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36264 - DNA, 313 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctcaccctctctcctacttcgcctggcctctctactgggcctgccagggctgcgtcctaaccggcgtctgggtcatagcccacgagtgcggccaccacgccttcagcgactac

SEQ ID NO: 36265 - DNA, 274 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 36266 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36267 - DNA, 367 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagtcctgtcgggtttcgccacctctgacttgagcgtcgatttttgtgatgctcggagacctcaagaaagcaatcccacctcactgcttcaaacgctccatcccacgctccttctcctcttcgacatcatcatctcctcctcggctcctccctcaccctctctcctacttcgcctggcctctctactgggcctgccaagggtgcgtcctaaccggcgtctgggtcatagcccacgagtgcggccaccacgccttcagcgactac

SEQ ID NO: 36268 - DNA, 346 bp, Artificial
  Mutation in BnaC.FAD2.b introduced by TALE nuclease pair BnFAD2_T03
caggatcatgggtgcaggtggacgaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36269 - DNA, 331 bp, Artificial
  Mutation in BnaC.FAD2.b introduced by TALE nuclease pair BnFAD2_T03
caggatccatgggtgcaggtggaagaatgcaagtctctcctccctccaaaaagtctgaaaccgacaacatcaagcgcgtaccctgcgagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36270 - DNA, 329 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtaccctgcgagacaccgcccttcaactcaagaaagcaatcccaccgcactgtttcaaacgctccatcccacgctccttctcctcttcgacatcatcatctcctcctcggctcctccctctaccacctccccacagcctacttccctctcccttacctcgcctgacccctctactgggcctgccaaggctgcgtcctaacgggcctctgggtcatagcccacgagtgcggccaccactccttcagcgactac

SEQ ID NO: 36271 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtaccctgcgagacaccgcccttcaactcaagaaagcaatcccaccgcactgtttcaaacgctccatcccacgctccttctcctcttcgacatcatcatctcctcctcggctcctccctctaccacctccccacagcctacttccctctcccttacctcgcctgacccctctactgggcctgccaaggctgcgtcctaacgggcctctgggtcatagcccacgagtgcggccaccacgccttcagcgactac

SEQ ID NO: 36272 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 36273 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcttgaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgacctaacgggcctctgggtcatcgcccacgaatgcggccaccacgccttcagcgactac

SEQ ID NO: 36274 - DNA, 280 bp, Artificial
  Mutation in BnaC.FAD2.b introduced by TALE nuclease pair BnFAD2_T03
caggatccatgggtgcaggtggaagaatgcaagtctcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36275 - DNA, 357 bp, Artificial
  Mutation in BnaC.FAD2.b introduced by TALE nuclease pair BnFAD2_T03
caggatccatgggtgcaggtggaagaatgcaagtctctcctccttccagctcccccgaaaccaaaaccctcaaacgcgtcccctgcgagacaccacccttcactctcggcctttttacggttcctctccctcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36276 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36277 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttacctcactgcttcaaacgctccatccctcgctccttctcctacctcctcttcgacatcctcgtctcctcctccctctaccacctctccacagcctacttccctctcctccaccaccctctcccttacctcgcctggcccctctactgggcctgccaaggctgcgtcctaacgggcctctgggtcatcgccaacgaatgcggccaccacgccttcagcgactac

SEQ ID NO: 36278 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 36279 - DNA, 437 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgactatcagtcaaaataaaatcattatttgccatgtacttggattggatctagatgtattcgacgcgagagtagggaactgccaggcatcaaataaaacgaagacctcaagaaagcaatcccacctcactgcttcaaacgctccatccctcgcccctccccctacctcctctccgacatccccgtctcctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36280 - DNA, 390 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcgcaattaatacgcgtaccgctagcccgcacgagtttgtagaaacccacaacggagacctcaagaaagcaatcccacctcactgcttccaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccactccttcagcgactac

SEQ ID NO: 36281 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcgacctcaagaaaacaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36282 - DNA, 398 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgtcggccatcgccagcaatggcggtggcaagcaggcgctggagacggtccagcggctgtttccggagaactcaagaaagcaatcccacctcactgcttcaaacgctccatccctcgctccttctcctacctcctcttcgacatcctcgtctcctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36283 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtccccttcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 36284 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacggagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 36285 - DNA, 348 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 36286 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 36287 - DNA, 334 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacaccacccttcactcgacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 36288 - DNA, 337 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36289 - DNA, 356 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgacggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36290 - DNA, 345 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36291 - DNA, 344 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccaagagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36292 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaactggcctctgggtcatagcccacgagtgcggccaccacgccttcagcgactac

SEQ ID NO: 36293 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36294 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 36295 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36296 - DNA, 335 bp, Artificial
  Mutation in BnaC.FAD2.b introduced by TALE nuclease pair BnFAD2_T03
caggatccatgggtgcaggtggcagaatgcaagtctctactccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36297 - DNA, 328 bp, Artificial
  Mutation in BnaC.FAD2.b introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36298 - DNA, 426 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttgggctcccccatcgactacggcgtgatcgtgaacaccaaggcctactccggcggctacgctatggaactcgccgcccgactgggctggcgagacctcaagaaagcaatcccacctcactgcttcaaacgctccatccctcgctcctccccctaccgcctcttcgacatcctcgtcccctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36299 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgctgccaccacgccttcagcgactac

SEQ ID NO: 36300 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36301 - DNA, 397 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagccgaacgaccgagcgcagcgagtcagtgagcgaggaagcggaagagcgcccaatacgcggagacctcaagaaagcaatcccacctcactgcttcaaacgctccatcccacgctccttctcctcttcgacatcatcatctcctcctcggctcctccctctaccacctctccacagcctacttccctctcccttacctcacctgacccctctactgggcctgccaaggctgcgtcctaacgggcctctgggtcatagcccacgaatgcggccaccacgccttcagcgactac

SEQ ID NO: 36302 - DNA, 351 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaccctcaagcgcgtaccctgcgagacaccgcccttcactgtcagaccccaagagagcaatcccacctcactccttcaaacgctccacccctcgctcctcctcctacctcctctccgacctcctcgtctcctcctccctctaccacccctccacagcctacttccctcccctcccccaccctctcccttacctcgcctggcccctctactgggcctgccaaggctgcgtcctaacgggcctctgggtcatcgcccacgaatgcggccaccacgccttcagcgactac

SEQ ID NO: 36303 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccatcccacgctccttctcaagaaagcaatcccacctcactgcttcaaacgctccatcccacgctccttctcctcttcgacatcatcatctcctcctcggctcctccctctaccacctctccacagcctacttccctctcccttacctcgcctgacccatctactgggcctgccaaggctgcgtcctaacgggcctctgggtcatcgcccacgaatgcggccaccacgccttcagcgactac

SEQ ID NO: 36304 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 36305 - DNA, 350 bp, Artificial
  Mutation in BnaC.FAD2.b introduced by TALE nuclease pair BnFAD2_T03
caggatccatgggtgcaggtggaagaatgcaagtttctcctccctccagctcccccggaaccaacaccctcaaacgcgtcccctgcgagacaccacccttcactcgagacctcaagaaagcaatcccacctcactgcttcaaacgctccatccatcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcaccgactac

SEQ ID NO: 36306 - DNA, 342 bp, Artificial
  Mutation in BnaC.FAD2.b introduced by TALE nuclease pair BnFAD2_T03
caggatccatgggtgcaggtggcagaatgcaagtttatacacacccccgctcccccggaaccaacaccctccaacgcgtcccctgcgagacaccaccattcactcagacctcaagacagcaatcccacctcactgcttcaaacgctccatccctcgctccttctcctacctcctcttcgtcatcatcatctcctcctcggctcctccccctaccacctctcctcagcctacttccctctcccttacctcgcctggcccctctacggggcctgccaaggcggcttccggacgggcctcggtgtcattgcccacgagtgcgtcctcctcgcctgcatcgactac

SEQ ID NO: 36307 - DNA, 322 bp, Artificial
  Mutation in BnaC.FAD2.b introduced by TALE nuclease pair BnFAD2_T03
caggatccatgggtgcaggtagaagaatgcaagtctctcctccctccagctcccccggaaccaacaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36308 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcatacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 36309 - DNA, 426 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctccccccagcaggtggtggccatcgccagcaatggcggtggcaagcaggcgctggagacggtccagcggctgttgccggtgctgtgccaggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36310 - DNA, 349 bp, Artificial
  Mutation in BnaC.FAD2.b introduced by TALE nuclease pair BnFAD2_T03
caggatccatgggtgcaggtggaagaatgcaagtctctcctccctcccgctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgcctgcagcgactac

SEQ ID NO: 36311 - DNA, 350 bp, Artificial
  Mutation in BnaC.FAD2.b introduced by TALE nuclease pair BnFAD2_T03
caggatccatgggtgcaggtggtagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36312 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaaacgcgtcccctgttatcgagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36313 - DNA, 324 bp, Artificial
  Mutation in BnaC.FAD2.b introduced by TALE nuclease pair BnFAD2_T03
caggatccatgggtgcaggtggcagaatgcaagtctctcctccctcccgctcccccggaaccaacaccctcaaacgcgtcccctgcgagacaccaccattcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggcggcgtccttacgggcctctgggtcatagcccacgagtgcggccaccacgccttcagcgactac

SEQ ID NO: 36314 - DNA, 423 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctcgacttcgctgctacccaaggttgccccacgagtacatcgagctgatcgagatcgcccggaacagcacccaagagccctcaagaaagcaatcccacctcactgcttcaaacgctccatccctcgctccttctcctacctcctcttcgacatccccgtctcctcctccctctaccacctctccccagcctacttccccctcctcccccaccctctcccttccctcgcctggcccctctactgggcctgccaaggctgcgtcctaacgggcctctgggtcatagcccacgagtgcggccaccacgccttcagcgactac

SEQ ID NO: 36315 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacacctcaataaagcaagcccacctccctccctcaaacgctccatccctcgctccttctcccacctcctcttcgacatcctcgtctcctcctccctctcccacctctcctcagcccacttccctcccctccccctccctctcccttacctcgcctggcccctctactgggcctgccaaggctgcgtcctaaccggcgtctgggtcatagcccacgagtgcggccaccacgccttcagcgactac

SEQ ID NO: 36316 - DNA, 332 bp, Artificial
  Mutation in BnaC.FAD2.b introduced by TALE nuclease pair BnFAD2_T03
caggatccatgggtgcaggtggaagaatgcaagtgtctactccctccagctcccccggaaccaacaccctcaaacgcgtcccctgcgagacaccacccttcactgacctcaagaaagcaatcccacctcactgcttcagacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36317 - DNA, 351 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactgtagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36318 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccaccatcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36319 - DNA, 367 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaacgcgtcccctgcgagacaccaccattcactctcggcatcaaactaagcagaaggccatccgtcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgtgcctctgggtcatagcccacgagtgcggccaccacgccttcagcgactac

SEQ ID NO: 36320 - DNA, 475 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgcctggcacagcaccggcaacagccgctggaccgtctccagcgcctgcttgccgccatcgtggctggcgatggccaccacctgctccggggtcaagccgtgggcctggcacagcaccggcaacaggcgctggcactcagagacctcaagaacgcaatcccccctcactgcttcaaacgctccatcccacgctcctcctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccctcagcgactac

SEQ ID NO: 36321 - DNA, 327 bp, Artificial
  Mutation in BnaC.FAD2.b introduced by TALE nuclease pair BnFAD2_T03
caggatccatgggtgcaggtggaagaatgcaagtgtctcctccctccagctaccccggaaccaacaccctcaaacgcgtcccctgcgagacaccaccagacctcaagaaagcaatcccgcctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36322 - DNA, 335 bp, Artificial
  Mutation in BnaC.FAD2.b introduced by TALE nuclease pair BnFAD2_T03
caggatccatgggtgcagttggaagaatgcaagtctctcctccctccagctcccccggaaccaacaccctcaaacgcgtcccctgcgagacaccaccattcactgagacctcaagaaagcaatcccacctcactgcttcaaacgctccatcctacgctccttctcctcttcgacatcatcatctcctcctcggctcctccctctaccacctctccacagcctccttccctctcccttacctcgcctaacccctctactgggcgtgccaaggctgcgtcctaacgggcctcttggtcatagcccacgagtgcggccaccgcgccatcaacgactac

SEQ ID NO: 36323 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagacctcaagaaagcaatcccacctcactgcttcaaacgctccatccctcgctccttctcctcttcgacatcatcatctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36324 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36325 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36326 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36327 - DNA, 343 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccatcagcgactac

SEQ ID NO: 36328 - DNA, 347 bp, Artificial
  Mutation in BnaC.FAD2.b introduced by TALE nuclease pair BnFAD2_T03
caggatccatgggtgcaggtggcagaatgcaagtttctcctccctccagctcccccggaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 36329 - DNA, 336 bp, Artificial
  Mutation in BnaC.FAD2.b introduced by TALE nuclease pair BnFAD2_T03
caggatccatgggtgcaggtggcagaatgcaagtctctcatccctccagctcccccggaaccaacaccctcaaacgcgtcccctgcgagacaccaccattcactctagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctggatcatagcccacgagtgcggccaccacgccttcagcgactac

SEQ ID NO: 36330 - DNA, 332 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttctacatcatcatctcctcctcggctcctccctctaccacctctcctcccccaccctctcccttacctcgcctggcccctctactgggcctgccaaggctgcgtcctaacgggcctctgggtcatcgcccacgaatgtggccaccacgccttcagcgactac

SEQ ID NO: 36331 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36332 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 36333 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcgacctcaagaaagcaatcccacctcactgcttcaaacgctccatcccacgctccttctcctcttcgacatcatcatctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36334 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgctagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36335 - DNA, 315 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctaagaccccaagaaagcaatcccacctcactgcttcaaacgctccatcccacgctccttctcctcttcgacatcatcatctcctcctcggctcctccctcaccctctctcctacttcgcctggcctctctactgggcctgccaagggtgcgtcctaacgggcctctgggtcatcgcccacgaatgcggccaccacgccttcagcgactac

SEQ ID NO: 36336 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctccattacctcgcctggcccctctactgggcctgccaaggctgcgtcctaacgggcctctgggtcatcgcccacgaatgcggccaccacgccttcagcgactac

SEQ ID NO: 36337 - DNA, 274 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36338 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36339 - DNA, 335 bp, Artificial
  Mutation in BnaC.FAD2.b introduced by TALE nuclease pair BnFAD2_T03
caggatccatgggtgcaggtggaagaatgcaagtctctcctccctccagcccccccggaaccaacaccctcaaacgcgtcccctgcgagacaccaccattcactctagacctcaagaaagcaatcccacctcactgcttcaaacgctccacccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36340 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36341 - DNA, 397 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattccggatggcctttttgcgtttccacaaactcttcctggctagcggtacgcgtattaattgcgttgcgagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 36342 - DNA, 407 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttcttcctggctagcggtacgcgtattaattgcgttgcgctcactgcccgctttccagagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 36343 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36344 - DNA, 411 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactctcggagcaggtggtggccatcgccagcaatattggtggcaagcaggcgctggagacggtgcgagacctcaagaaagcaatcccacctcactgcttcaaacgctccatccctcgctccttctcctacctcctcttcgacatcctcgtcgcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36345 - DNA, 441 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcacagcaccggcaacagccgctggaccgtctccagcgcctgcttgccaccgccaagccgtgggcctggcacagcaccggcaacagccgctggacgacctcaagaaagcaatcccacctcactgcttcaaacgctccatccctcgctccttctcctgcctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36346 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36347 - DNA, 394 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagacaccaccattcactcttggccaccacctgctccggggtcaagctggaggggtacaccttccaccactcgttgggagacctcaagaaagcaatcccacctcactgcttcaaacgctccatcccacgctccttctcctcttcgacatcatcatctcctcctcggctcctccctctcccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 36348 - DNA, 426 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctccccccagcaggtggtggccatcgccagcaatggcggtggcaagcaggcgctggagacggtccagcggctgttgccggggctgtgccaggagacctcaagaaggcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36349 - DNA, 335 bp, Artificial
  Mutation in BnaC.FAD2.b introduced by TALE nuclease pair BnFAD2_T03
caggatccatgggtgcaggtggaagaatgcaagtctctcgtccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtcctaacgggcctctgggtcatcgcccacgaatgcggccaccacgccttcagcgactac

SEQ ID NO: 36350 - DNA, 336 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36351 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 36352 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctaccccaccctctcccttacctcgcctggcccctctactgggcctgccaaggctgcgtcctaacgggcctctgggtcatcgcccacgaatgcggccaccacgccttcagcgactac

SEQ ID NO: 36353 - DNA, 336 bp, Artificial
  Mutation in BnaC.FAD2.b introduced by TALE nuclease pair BnFAD2_T03
caggatccatgggtgcaggtggcagaatgcaagtgtctactccctccaagaagtctgaaaccgacaccatcaagcgcgtaccctgcgagacaccgcccttcactgtagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36354 - DNA, 306 bp, Artificial
  Mutation in BnaC.FAD2.b introduced by TALE nuclease pair BnFAD2_T03
caggatccatgggtgcaggtggcagaatgcaagtctctaccccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36355 - DNA, 331 bp, Artificial
  Mutation in BnaC.FAD2.b introduced by TALE nuclease pair BnFAD2_T03
cggatccatgggtgcaggtggaagaatgcaagtctctcctccctccagctcccccgaaaccaaaaccctcaaacgcgtcccctgcgagacaccacccttcactccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcttggtcatagcccacgagtgcggccaccacgccttcagcgactac

SEQ ID NO: 36356 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 36357 - DNA, 348 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactctacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 36358 - DNA, 415 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgatgggcaggttgtagccgccggagtaggccttggtgtccacgatcacgccgtagtcgatggggagacctcaagaacgcaatcccacctcactgcttcaaacgctccatccctcgctccttctcctacctcctcttcgacatcctcgtctcctcctccctctaccacctctccacagcctacttccccctccccccccaccctctcccttacctcgcctggcccctctactgggcctgccaaggctgcgtcctaacgggcctctgggtcatcgcccacgaatgcggccaccacgccttcagcgactac

SEQ ID NO: 36359 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactaaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36360 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36361 - DNA, 333 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagacaccaccattcacagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 36362 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgacctcaagaaagcaatcccacctcactgcttcaaacgctccatccctcgctccttctcctacctcctcttcgacatccacgtctcctcctccctctaccacctctccacagcctacttccctctcctcccccaccctctccctgtcctcgcctggcccctctactgggcatgccatggctgcgtcctaacgggcctctgggtcatcgcccacgaatgcggccaccacgccttcagcgactac

SEQ ID NO: 36363 - DNA, 336 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactctggacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36364 - DNA, 336 bp, Artificial
  Mutation in BnaC.FAD2.b introduced by TALE nuclease pair BnFAD2_T03
caggatccatgggtgcaggtggaataatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36365 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatttcggagacctcaagaaagcaatcccacctcactgcttcaaacgccccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36366 - DNA, 378 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgcgatggcggcaagcaggcgctggagaagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctgacccctctactgggcctgccaaggctgcgtcctaacgtgcctctgggtcatagcccacgagtgcggccaccacgccttcagcgactac

SEQ ID NO: 36367 - DNA, 333 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36368 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaacaaagcaatcccacctcactgcttcaaacgctccatcccacgctccttctcctacctcctcttcgacatcctcgtctcctcctccctctaccacccctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 36369 - DNA, 334 bp, Artificial
  Mutation in BnaC.FAD2.b introduced by TALE nuclease pair BnFAD2_T03
caggatccatgggtgcaggtagaagaatgcaagtctctcctccctccagctcccccggaaccaacaccctcaaacgcgtcccctgcgagacaccaccatttcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctcttctgggcctgccaaggctgcgtcctaacgggcctctgggtcatcgcccacgaaggcggccaccacgccttcagcgactac

SEQ ID NO: 36370 - DNA, 314 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36371 - DNA, 317 bp, Artificial
  Mutation in BnaC.FAD2.b introduced by TALE nuclease pair BnFAD2_T03
caggatccatgggtgcaggtggcagaatgcaagtctctactccctccagctcccccgaaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36372 - DNA, 300 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36373 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccatcaaacgcgtcccctgcgagacaccacccttcactcgagaccacaagaaagaaatcccacctcacttcttcaaaccccccatccctcgctccttctcctacctcctcttcgacatcctcgtcacctcctccctctaccacctctccacagcctacttccctctcctcccccaccctctcccttacctcgcctggcccctctactgggcctgccaaggctgcggcctaacgggcctctggggcatcgcccacgaatgcggccaccacgccttcagcgactac

SEQ ID NO: 36374 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattagacctcaagaaagcaatcccacctcactgcttcaaacgctccatcccacgctccttctcctcttcgacatcatcatctcctcctcggctcctccctctaccacctctccacaacctacttccctctcccttacctcgcctgacccctctactgggcctgccaaggctgcgtcctaacgggcctctgggtcatagcccacgagtgcggccaccacgccttcagcgactac

SEQ ID NO: 36375 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaccccctcaaacgcgccccctgcgagaccccaccagagacctcaagaacgcaatcccacctcactgcttcaaccgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36376 - DNA, 333 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacacctcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36377 - DNA, 387 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttgaccccggagcaggtggtggccatcgccagccacgatggcggcaagcaggcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcgtcgcccacgaatgcggccaccacgccttcagcgactac

SEQ ID NO: 36378 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccacctcactgcttcaaacgctccatccctcgctccttctcctacctcctcttcgacatcctcgtctcctcctccctctaccacctctccacagtctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36379 - DNA, 347 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctcgtgagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 36380 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccgacctcaagaaagcaatcccaccgcactgtttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 36381 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatcttggacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36382 - DNA, 447 bp, Artificial
  Mutation in BnaC.FAD2.b introduced by TALE nuclease pair BnFAD2_T03
caggatccatgggtgcaggtggaagaatgcaagtgtctcctccctccaagaagtctgaaacctacaccatcaagcgcgtaccctgcgagacaccccagcaggtggtggccatcgccagcaataatggtggtaagcaggcgctggagacggtgctgtgccaggcccacggcttgaccccccagcaggtggtggccatcgccagcaaaactcaagaaagtaatcccaccgcactgtttcaaacgctccatccctcgctccttctcctacctccccttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36383 - DNA, 432 bp, Artificial
  Mutation in BnaC.FAD2.b introduced by TALE nuclease pair BnFAD2_T03
caggatccatgggtgcaggtggcagaatgcaagtttctactccctcaagctcccccgaaaccaaaaccctcaaacgcatcccctgcgagacaccaccattcactctcggcctggagacggtccagcggctggtgccggtgctgtgccaggcccacggcttgaccccggagcaggtggtggccatcgccggccacgatggcggagacctcaagaaagcaatccctcctcactgcttcaaacgctccatcccacgctccttctcctcttcggcaccatcacctcctcctcgcctcctccccctcccacctccccacagccttcttccctctcccttccctcgcctgacccctctactgggcctgccaaggctgcggccgaacgggcctctgggtcatagcccacgagtgcggccaccgcgccttcagcgactac

SEQ ID NO: 36384 - DNA, 428 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccgtccagcggctgttgccggtgctgtgccaggcccacggcttgaccccggagcaggtggtggccatcgccagccacgatggcggcaagcaggcgctggagagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36385 - DNA, 368 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgagcgccatctcgaaccgacgttgctggccgagacctcaagaaagcaatcccacctcactgcttcaaacgctccatcccacgctccttctcctcttcgacatcatcatctcctcctcggctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 36386 - DNA, 283 bp, Artificial
  Mutation in BnaC.FAD2.b introduced by TALE nuclease pair BnFAD2_T03
caggatccatgggtgcaggtggcagaatgcaagtgtctcctccctcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36387 - DNA, 342 bp, Artificial
  Mutation in BnaC.FAD2.b introduced by TALE nuclease pair BnFAD2_T03
caggatccatgggtgcaggtggcagaatgcaagtgtctactccctccaagaagtctgaaaccgacaccatcaagcgcgtaccctgcgagacaccgcccttcactcaagaaagcaatcccacctcactgcttcaaacgctccatccctcgctccttctcctacctcctcttcgacatcctcgtctcctcctccctctaccacctctccacagcctacttccctctactcccccaccctctcccttacctcgcctggcccctctactgggcctgccaaggctgcgtcctaacgggcctctgggtcatcgcccacgaatgcggccaccacgccttcagcgactac

SEQ ID NO: 36388 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctgacccctctactgggcctgccaaggctgcgtcctaacgggcctctgggtcatcgcccacgaatgcggccaccacgccttcagcgactac

SEQ ID NO: 36389 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36390 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccaagagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggtccctctactgggcctgccaaggctgcgtcctaacgggcctctgggtcatcgcccacgaatgcggccaccacgccttcagcgactac

SEQ ID NO: 36391 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36392 - DNA, 401 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaactatcgtcttgagtccaaccctgtaagacacgacttatcgccactggcagcagccactggtaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36393 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacttggcctgccaaggctgcgtcctaacgggcctctgggtcatcgcccacgaatgcggccaccacgccttcagcgactac

SEQ ID NO: 36394 - DNA, 408 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttggccaccacctgctccggggtcaagctggaggggtacaccttccaccactcgttgggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36395 - DNA, 291 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgaactcaagaaagcaatcccacctcactgctccaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36396 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgtgtcctaacgggcctctgggtcatagcccacgagtgcggccaccacgccttcagcgactac

SEQ ID NO: 36397 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 36398 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcatcctaacgggcctctgggtcatcgcccacgagtgcggccaccacgccttcagcgactac

SEQ ID NO: 36399 - DNA, 336 bp, Artificial
  Mutation in BnaC.FAD2.b introduced by TALE nuclease pair BnFAD2_T03
caggatccatgggtgcaggtggaagaatgcaagtctctcctccctccagcccccccgaaaccaaaaccctcaaacgcgtcccctgcgagacaccacccttcactctagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36400 - DNA, 313 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctcaccctctctcctacttcgcctggcctctctactgggcctgccagggctgcgtcctaaccggcgtctgtgtcatagcccacgagtgcggccaccacgccttcagcgactac

SEQ ID NO: 36401 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36402 - DNA, 349 bp, Artificial
  Mutation in BnaC.FAD2.b introduced by TALE nuclease pair BnFAD2_T03
caggatccatgggtgcaggcggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgcctgcagcgactac

SEQ ID NO: 36403 - DNA, 350 bp, Artificial
  Mutation in BnaC.FAD2.b introduced by TALE nuclease pair BnFAD2_T03
caggatccatgggtgcaggtcgcagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 36404 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgtagagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36405 - DNA, 343 bp, Artificial
  Mutation in BnaC.FAD2.b introduced by TALE nuclease pair BnFAD2_T03
caggatccatgggtgcaggtggaagaatgcaagtctctcctccctccagctccccccaaaccaaaaccctcaaacgcgtcccctgcgagacaccacccttcactctagaaagcaatcccacctcactgcttcaaacgctccatcccacgctccttctcctcttcgacatcatcatctcctcctcggctcctccctctaccacccctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 36406 - DNA, 351 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36407 - DNA, 423 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcgactacggcgtgatcgtggacaccacgagcatcacaaaaatcgacgctcaagtcagaggtggcgaaacccggagacctcaagaaagcaatcccacctcactgcttcaaacgctccatccctcgctccttctcctacctcctcttcgacatcctcgtcccctcccccctctaccacctctccacagcctacttccctctccccccccaccctctcccttacctcgcctggcccctctactgggcctgccaaggctgcgtcctaacgggcctctgggtcatcgcccacgaatgcggccaccacgccttcagcgactac

SEQ ID NO: 36408 - DNA, 362 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactcaatggcggtggcaagcaggcgctggagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggactctgggtcatagcccacgagtgctgccaccacgccttcagcgactac

SEQ ID NO: 36409 - DNA, 440 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctccccccagcaggtggtggccatcgccagcaatggcggtggcaagcaggcgctggagacggtccagcggctgttgccggtgctgtgccaggagacctcaagaaagcaatcccacctcactgcttcaaacgctccatccctcgctccttctcctacctcccctccgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 36410 - DNA, 404 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttgctggcgatggccaccacctgctggggggtcaagccgtgggcctgacacagcaccggcaacagccgctggacccacctcactgcttcaaacgctccatccctcgctccttctcctacctcctcttcgacatcctcgtctcctcccccctctaccacccctccccagcctacttccctcccctcccccaccctctcccttacctcgcctggcccctctactgggcctgccaaggctgcgtcctaacgggcctctgggtcatcgcccacgaatgcggccaccacgccttcagcgactac

SEQ ID NO: 36411 - DNA, 335 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36412 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 36413 - DNA, 324 bp, Artificial
  Mutation in BnaC.FAD2.b introduced by TALE nuclease pair BnFAD2_T03
caggatccatgggtgcaggtggaagaatgcaagtctctcctccaccaacaccctcaaacgcgtcccctgcgagacaccaccattcactctcgggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 36414 - DNA, 349 bp, Artificial
  Mutation in BnaC.FAD2.b introduced by TALE nuclease pair BnFAD2_T03
caggatccatgggtgcaggtggaataatgcaagtctctcctccctccagctcccccggaaccaacaccctcaaacgcgtcccctgcgagacaccaccattcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36415 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36416 - DNA, 335 bp, Artificial
  Mutation in BnaC.FAD2.b introduced by TALE nuclease pair BnFAD2_T03
gaggatccatgggtgcaggtggaagaatgcaagtctctcctccctccagatgccccggaacaaacaccctcaaacgcggcccctgcgagacaccaccattcactgagacctcaagaaagcaatcccaccgcactgcttcaaacgctccatcccacgcgccttctcctcttcgacatcatcatctcctcctcggatcctccctctaccacctctccacagcctacttccctctccctcacctcgcctgacccctctactgggcctgcccaggctgcgtcctaactggcctctgggtcctagcccacgagtgcggccaccacgccttcagcgactac

SEQ ID NO: 36417 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagcctgcgtcctaaagggcctccgggtcatagcccacgagtgcggccaccacgccttcagcgactac

SEQ ID NO: 36418 - DNA, 335 bp, Artificial
  Mutation in BnaC.FAD2.b introduced by TALE nuclease pair BnFAD2_T03
caggatccatgggtgcaggtggcagaatgcaagtctctcctcactcccgctcccccgaaaccaacaccatcaaacgcgtcccctgcgagacaccaccattcactgagacctcaagaaagcaatcccacctcactacttcaaacgctccatcccacgctccttctcctcttcgacaccatcatctcctcctcggctcctccctctaccacctctccacagcctacttccctctcccttacctcgcctgacccctctactgggcctgccaaggctgcgtcctaacgggcctctgggtcatagcccacgagtgcgtccaccacgccttcagcgactac

SEQ ID NO: 36419 - DNA, 340 bp, Artificial
  Mutation in BnaC.FAD2.b introduced by TALE nuclease pair BnFAD2_T03
caggatccatgggtgcaggtggaagaatgcaagtctctcctccctacagctcccccggaaccaaaaccctcaaacgcgtcccctgcgagacaccacccttcactctaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36420 - DNA, 371 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgccggtgctgtgccaggcccagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36421 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36422 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36423 - DNA, 416 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccagcaatattggtggcaacgaacaggtcactatcagtcaaaataaaatcattatttgccatgtacgaagacctcaagaaagcaatcccacctcactgcttcaaacgctccatccctcgctccttctcctacctcctcttcgacatcctcgtctcctcctccctctaccccctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36424 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36425 - DNA, 355 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccatcaaacgcgtcccctgcgagacaccacccttcactcttttggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 36426 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttacctcaagaaagcaatcccacctcactgcttcaaacgctccatcccacgctccttctcctcttcgccatcatcatctcctcctcgcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 36427 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 36428 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtaatagcccacgagtgcggccaccacgccttcagcgactac

SEQ ID NO: 36429 - DNA, 446 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcacggcgatggccaccacctgctccggggtcaagccgtgggcctggcacactccgggccgttgcttcacaacgttcaaatccgctcctggcggatttgtcctagacctcaagaaagcaatcccacctcactgcttcaaacgctccatccctcgctccttctcctacctcccctccgacatcctcgtctccgcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 36430 - DNA, 330 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactcctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36431 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36432 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcatacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36433 - DNA, 336 bp, Artificial
  Mutation in BnaC.FAD2.b introduced by TALE nuclease pair BnFAD2_T03
caggatccatgggtgcaggtggcagaatgcaagtgtctactcactccaagaagtctgaaaccgacaacatcaagcgcgtaccctgcgagacaccgcccttcactgtagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36434 - DNA, 348 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacaccaccattcactctcctcaagaaagcaatcccacctcactgcttcaaacgctccatcccacgctccttctcctcttcgacatcatcatctcctcctcggctcctccctctaccacctctccacagcctacttccctctcctcccccaccctctccctaaccacacctggcaccagaacggggcctgccaaggcagcgtcctaacgggccgcggggtcatagcccacgagtgcggccaccacgccttcagcgactac

SEQ ID NO: 36435 - DNA, 331 bp, Artificial
  Mutation in BnaC.FAD2.b introduced by TALE nuclease pair BnFAD2_T03
caggatccatgggtgcaggtggcagaatgcaagtctctactccctccagctcccccgaaaccaaaaccctcaaacgcgtcccctgcgagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36436 - DNA, 323 bp, Artificial
  Mutation in BnaC.FAD2.b introduced by TALE nuclease pair BnFAD2_T03
caggatccatgggtgcaggtggaagaatgcaagtctatcctccctccagctcccccggaaccaaaaccctcaaacgcgtcccctgcgagacaccacccttcaagaaagcaatcccacctcactgcttcaaacgctccatccctcgctccttctcctacctcctcttcgacatcctcgtctcctcctccctctaccacctctccacagcctacttccctctcccttacctcgcctggcccctctactgggcctgccaaggctgcgtcctaacgggcctctgggtcatagcccacgtgtgctgccaccacgccttcagcgactac

SEQ ID NO: 36437 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36438 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36439 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagtccacgagtgcggccaccacgccttcagcgactac

SEQ ID NO: 36440 - DNA, 427 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccttcaaacgcgtcccctgcgagacaccaccattcactcacgatggccaccacctgctccggggtcaagccgtcgatttttgtgatgctcgtcaggggggcggagcctatggaaaaacgccagcaacgcggagacctcaagaaagcaatcccacctcactgcttcaaacgctccatcccacgctcctcctcctcttcgacatcatcatctcctcctcggctcctccctctaccacctctccacagcctacttccctctcccttccctcgcctgacccctctactgggcctgccaaggctgcgtcctaacgggcctctgggtcatagcccacgagtgcggccaccacgccttcagcgactac

SEQ ID NO: 36441 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36442 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcagacctcaagagagcaatcccccctcactgcttctaacacgccacaccacgccccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 36443 - DNA, 408 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccactcaaatccgctcccggcggatttgtcctactcaggagagcgttcaccgacaaacaacagataaaacgaagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 36444 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgccccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36445 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36446 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 36447 - DNA, 343 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactctcggtcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36448 - DNA, 396 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctggcgatggccaccaccattcactcggggggtcaagccgtgggcctggcacagcaccggcaacagccgcagacctcaagaaagcaatcccacctcactgcttcaaacgctccatccctcgctccttctcctacctcctcttcgacatcctcgtctcctcctccctctaccacctctccaccgcctacttccctctcctccccccccctctcccttacctcgcctggcccctctactgggcctgccaaggctgcgtcctaacgggcctctgggtcatcgcccacgaatgcggccaccacgccttcagcgactac

SEQ ID NO: 36449 - DNA, 400 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactctcggcaccggcaacagccgctggaccgtctccagcgcctgcttgccaccagagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 36450 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctaaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36451 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36452 - DNA, 281 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36453 - DNA, 354 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctccatcccacgctccttctcctcttcgacatcatcatctcctcctcggctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36454 - DNA, 339 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36455 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggtcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36456 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacctcaagaaagcaatcccacctcactgcatcaaacgcaccatcccacgctccttctcctctccgccatcatcatctcctcctcggctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 36457 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36458 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36459 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccagggctgcgtcctaaccggcgtctgggtcatagcccacgagtgcggccaccacgccttcagcgactac

SEQ ID NO: 36460 - DNA, 337 bp, Artificial
  Mutation in BnaC.FAD2.b introduced by TALE nuclease pair BnFAD2_T03
caggatccatgggtgcaggtggaagaatgcaagtctctcctccctcccgctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgtgtcctaacgggcctctgggtcatagcccacgagtgcggccaccacgccttcagcgactac

SEQ ID NO: 36461 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 36462 - DNA, 334 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgaccactctactgggcctgccaaggctgcgtcctaacgggcctctgggtcatagcccacgagtgcggccaccacgcctgcatcgactac

SEQ ID NO: 36463 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccctcagcgactac

SEQ ID NO: 36464 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 36465 - DNA, 296 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 36466 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcctcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36467 - DNA, 295 bp, Artificial
  Mutation in BnaC.FAD2.b introduced by TALE nuclease pair BnFAD2_T03
caggatccatgggtgcaggtggaagaatgcaagtctctcctcactccagctcccccgaaaccaaaaccctccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcgtccaccacgccttcagcgactac

SEQ ID NO: 36468 - DNA, 354 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttaaagacctcaagaaagcaatcccacctcactgcttcaaacgctccatccctcgctccttctcctacctcctcttcgacatcctcgtctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccatgccttcagcgactac

SEQ ID NO: 36469 - DNA, 295 bp, Artificial
  Mutation in BnaC.FAD2.b introduced by TALE nuclease pair BnFAD2_T03
caggatccatgggtgcaggtggaagaatgcaagtctctcctccccccagctcccccgaaaccaaaaccctccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36470 - DNA, 319 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36471 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccttagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36472 - DNA, 333 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36473 - DNA, 332 bp, Artificial
  Mutation in BnaC.FAD2.b introduced by TALE nuclease pair BnFAD2_T03
caggatccatgggtgcaggtggaagaatgcaagtctctcctccctcccgctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccacgggtgcgtcctaacctgcgtctgggtcatagcccacgagggcggccgccgcgccatcagcgactcc

SEQ ID NO: 36474 - DNA, 335 bp, Artificial
  Mutation in BnaC.FAD2.b introduced by TALE nuclease pair BnFAD2_T03
caggatccatgggtgcaggtagaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccagcacgccttcagcgactac

SEQ ID NO: 36475 - DNA, 332 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcggagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36476 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 36477 - DNA, 300 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 36478 - DNA, 376 bp, Artificial
  Mutation in BnaC.FAD2.b introduced by TALE nuclease pair BnFAD2_T03
caggatccatgggtgcaggtggcagaatgcaagtttatccaccctcccgctcccccggaaccaacaccctcaaacgcgtcccctgcgagacaccaccattcacttccgtgggcctggcacagcaccggcaacagccgctgtagacgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcctgcatcgactac

SEQ ID NO: 36479 - DNA, 349 bp, Artificial
  Mutation in BnaC.FAD2.b introduced by TALE nuclease pair BnFAD2_T03
caggatccatgggtgcaggtggcagaatgcaagtctatactcactccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgcctgcagcgactac

SEQ ID NO: 36480 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36481 - DNA, 350 bp, Artificial
  Mutation in BnaC.FAD2.b introduced by TALE nuclease pair BnFAD2_T03
caggatccatgggtgcaggtggaagaatgcaagtttctaatccctccagctcccccgaaaccaaaaccctcaaacgcgtcccctgcgagacaccaccctccactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccgtcagcgactac

SEQ ID NO: 36482 - DNA, 306 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctaccaaggctgcgtcctaacgggcctctgggtcatcgcccacgaatgcggccaccacgccttcagcgactac

SEQ ID NO: 36483 - DNA, 268 bp, Artificial
  Mutation in BnaC.FAD2.b introduced by TALE nuclease pair BnFAD2_T03
caggatccatgggtgcaggtggaagaatgcaagtctctagacctcaagaaagcaatcccacctcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36484 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaacaaacaccctcaaacgcgtcccctgcgagacaccaccattcactctgacctcaagaaagcaatcccacctcactgcttcaaacgctccatccctcgctccttctcctacctcctcttccacatcctcgtctcctcctccctctcccacctctccacatcctacttccctctcccccccccccctctcccttccctcccctggcccctctactgggcctgccaaggctgcgtcctaacgggcctctgggtcatagcccacgagtgcggccaccacgccctcagcgactac

SEQ ID NO: 36485 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactgc

SEQ ID NO: 36486 - DNA, 281 bp, Artificial
  Mutation in BnaC.FAD2.b introduced by TALE nuclease pair BnFAD2_T03
caggatccatgggtgcaggtggaagaatgcaagtctctcatccctccaggtagacctcaagaaagcaatcccacctcactgcttcaaacgctccatcccacgctccttctcctcttcgacatcatcatctcctcctcggctcctccctctaccacctctccacagcctacttccctctcccttacctctcctgacccctctactgggcctgccaaggctgcgtcctaacgggcctctgggtcatagcccacgagtgcggccaccacgccttcagcgactac

SEQ ID NO: 36487 - DNA, 336 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctcaacagcctacttccctctcccttacctcgcctgacccctctaatgggcctgccaaggctgcgtcctaacgggcctctgggtcatcgcccacgaatgcggccaccacgccttcagcgactac

SEQ ID NO: 36488 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgtgaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36489 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaccgcgtcccctgcgagacaccaccagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36490 - DNA, 403 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagatcggcgatatcgatgctgtccatgtgctgtctctcgaacttggcagcggcagtctccttatcggagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36491 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36492 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36493 - DNA, 329 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccaccattcactctcggaaagcaatcccacctcactgcttcaaacgctccatcccacgctccttctcctcttcgacatcatcatctcctcctcggcttctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 36494 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 36495 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36496 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36497 - DNA, 406 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccagcgcctgcttgccaccattattgctggcgatggccaccacctgctggggggtcaagttgagcggggcacccgtcagtgcattgcgccagagacctcaagaaagcaatcccacctcactgcttcaaacgctccatccctcgctccttctcctacctcctcttcgacatcatcatagcctcctgcttctactacgtcgccaccccttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 36498 - DNA, 333 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactcgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36499 - DNA, 350 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaacgggcctctgggtcatcgcccacgaatgcggccaccacgccttcagcgactac

SEQ ID NO: 36500 - DNA, 336 bp, Artificial
  Mutation in BnaC.FAD2.b introduced by TALE nuclease pair BnFAD2_T03
caggatccatgggtgcaggtggaagaatgcaagtgtctactccatccaagaagtctgaaaccgacaccatcaagcgcgtaccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36501 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatccctcgctccttctcctacctcctcttcgacatcatcatctcctcctcggctcctccctctaccacctctccacagcctacttccctctctcctacttcgcctggcctctctactgggcctgccaagggtgcgtcctaaccggcgtctgggtcatagcccacgagtgcggccaccacgccttcagcgactac

SEQ ID NO: 36502 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36503 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggacctcaagaaagcaatcccacctcactgcttcaaacgccccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36504 - DNA, 418 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcggatttgtcctactcaggagagcgttcaccgacaaacaacagataaaacgaaaggctcagtctttgacctcaagaaagcaatcccacctcactgcttcaaacgctccatccctcgctccttctcctacctcctcttcgacatcctcgtctcctcctccctctcccccctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36505 - DNA, 349 bp, Artificial
  Mutation in BnaC.FAD2.b introduced by TALE nuclease pair BnFAD2_T03
caggatccatgggtgcaggtggaagaatgcaagtctctcttccctccagctcccccgaaaccaaaaccctcaaacgcgtaccctgcgagacaccgcccttcacttagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36506 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctcctgggcccgccagggctgcctcctaacggacctctgggtcatagcccacgagtgcgtcctccacgccttcagcgactgc

SEQ ID NO: 36507 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgcctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36508 - DNA, 351 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36509 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagtccacgagtgcggccaccacgcttcagcgactac

SEQ ID NO: 36510 - DNA, 349 bp, Artificial
  Mutation in BnaC.FAD2.b introduced by TALE nuclease pair BnFAD2_T03
caggatccatgggcgcaggtggcagaatgcaagtatatcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 36511 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgccagacaccaccattcactcagacctcaagaaagcaatcccacctcactgcttcaaacgctccatcccacgctccttctcctcttcgacatcatcatctcctcctcggctcctccctctaccacctctccacagccttcttccctctcccttacctcgcctgacccctctactgggcctgccaaggctgcgtcctaacgggcctctgggtcatcgcccacgaatgcggccaccacgccttcagcgactac

SEQ ID NO: 36512 - DNA, 304 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcctctctactgggcctgccaaggctgcgtcctaacgggcctctgggtcatcgcccacgaatgcggccaccacgccttcagcgactac

SEQ ID NO: 36513 - DNA, 347 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36514 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctaactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgtgtcatagcccacgagtgcggccaccacgccttcagcgactac

SEQ ID NO: 36515 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatcttctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 36516 - DNA, 435 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgtccttcactgtcatcctcacctcctccagggtcagggtgccggcctttggtggcaagcaggcgctggagacggtccagcggctgttgccggtgcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 36517 - DNA, 357 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcgggtgtggtggttacgtagacctcaagaaagcaatcccacctcactgcttcaaacgctccctcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36518 - DNA, 344 bp, Artificial
  Mutation in BnaC.FAD2.b introduced by TALE nuclease pair BnFAD2_T03
caggatccatgggtgcaggtggaagaatgcaagtttctcctccctccagctcccccggaaccaacaccctcaaacgcgtcccctgcgagacaccaccattcactctcgggtcggagacctcaagaaagcaatcccacctcactgcttcaaacgctccatccccccctccttctcctcttcgacatcatcatctcctcctcggcccctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 36519 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggtcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 36520 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36521 - DNA, 347 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36522 - DNA, 425 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggggaaacgcctggtatctttatagtcctgtcgggtttcgccacctctgacttgagcgtcgatttttgtgatgctcgtcaggggggcagacctcaagaaagcaatcccacctcactgcttcaaacgctccatcccacgctccttcccctcttcgccatcatcacctcctccccggctcctccctctaccacctctccacagcctacttccctctcccttacctcccctgacccctctactgggcctgccaaggctgcgtcctaacgggcctctgggtcatagcccacgagtgcggccaccacgccatcagcgactac

SEQ ID NO: 36523 - DNA, 292 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36524 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36525 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 36526 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 36527 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 36528 - DNA, 374 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacaggcccacggcttgaccccccagcaggtggtggccatcgccagcaataatggtggcggagacctcaagaaagcaatcccacctcactgcttcaaacgctccatcccacgctccttctcctcttcgacatcatcatctcctcctcggctcctccctcaccctctctcctacttcgcctggcctctctactgggcctgccaaggctgcgtcctaacgggcctctgggtcatagcccacgagtgcggccaccacgccttcagcgactac

SEQ ID NO: 36529 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36530 - DNA, 391 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctaggcgacgaggtggtcgttggtcaacgcggccaacgccgggagacctcaagaaagcaatcccacctcactgcttcaaacgctccatccctcgctccttctcctacctcctcttcgacatcctcgtctcctcctccctctaccacccctccacagcctacttccctctccccccccaccctctcccttacctcgcctggcccctctactgggcctgccaaggctgcgtcctaacgggcctctgggtcatcgcccacgaatgcggccaccacgccttcagcgactac

SEQ ID NO: 36531 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccctgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36532 - DNA, 353 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggagacctcaagaaagcaatcccacctcactgcttcaaacgctccatcccacgctccgtctcctcttcgacatcatcatctcctcctcggctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 36533 - DNA, 349 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacccttcactctgacctcaagaaagcaaccccacctcactgcttcaaacgctacatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctggggcatcgcccacgaatgcggccaccacgccttcagcgactac

SEQ ID NO: 36534 - DNA, 299 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36535 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36536 - DNA, 330 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccaccattcacacctcaagaaagcaatcccacctcactgcttcaaacgctccaaccctcgctccttctcctacctcctcttcgacatcctcgtctcctcctccctctaccacctctccacagcctacttccctctcccttacctcgcctggcccctctactgggcctgccaaggctgcgtcctgacgggcctctgggtcatcgcccacgaatgcggccaccacgccttcagcgactac

SEQ ID NO: 36537 - DNA, 334 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccatttcggagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccagggctgcgtcctaaccggcgtctgggtcatagcccacgagtgcggccaccacgccttcagcgactac

SEQ ID NO: 36538 - DNA, 395 bp, Artificial
  Mutation in BnaC.FAD2.b introduced by TALE nuclease pair BnFAD2_T03
caggatccatgggtgcaggtggcagaatgcaagtctctactccctccagctcccccggaaccaacaccctcaaacgcgtcccctgcgagacaccaccattcactctcggccttctgcttagtttgatgcctggcagtttatggcgggcataagacctcaagaaagcaatcccacctcactgcttcaaccgctccacccctcgctccttctcctccctcccctccgacatcctcgtctcctcctccccctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36539 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36540 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccacgaaaccaaaaccctcaaacgcgtcccctgcgagacaccacccttcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36541 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36542 - DNA, 280 bp, Artificial
  Mutation in BnaC.FAD2.b introduced by TALE nuclease pair BnFAD2_T03
caggatccatgggtgcaggtggaagaatgcaagtctctcatccctccaggtagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36543 - DNA, 282 bp, Artificial
  Mutation in BnaC.FAD2.b introduced by TALE nuclease pair BnFAD2_T03
caggatccatgggtgcaggtggaagaatgcaagtctctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcatcgactac

SEQ ID NO: 36544 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcgcccaccacgccttcagcgactac

SEQ ID NO: 36545 - DNA, 278 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgacatcctcgtctcctcctccctctaccacctctccacagcctacttccctctcctcccccaccctctcccttacctcgcctggcctctctactgggcctgccaaggctgcgtcctaacgggcctctgggtcatcgcccacgagtgcggccaccacgccttcagcgactac

SEQ ID NO: 36546 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 36547 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 36548 - DNA, 412 bp, Artificial
  Mutation in BnaC.FAD2.b introduced by TALE nuclease pair BnFAD2_T03
caggatccatgggtgcatgtggaagaatgcaagtctctcctccctccagctcccccggaaccaacaccctcaaacgcgtcccctgcgagacaccaccattcactcagccgaacgaccgagcgcagcgagtcagtgagcgaggaagcggaagagcgcccaatacgcggagacctcaagaacgcaatcccacctcactgcttcaaacgctccatcccacgctccttctcctcttcgacatcatcatctcctcctcggctcctccctctaccacccctccccagcctacttccctctcctcccccaccctctcccttacctcgcctggcccctctactgggcctgccaaggctgcgtcctaacgggcctctgggtcatcgcccacgaatgcggccaccacgccgtcagcgactac

SEQ ID NO: 36549 - DNA, 412 bp, Artificial
  Mutation in BnaC.FAD2.b introduced by TALE nuclease pair BnFAD2_T03
caggatccatgggtgcatgtggaagaatgcaagtctctcctccctccagctcccccggaaccaacaccctcaaacgcgtcccctgcgagacaccaccattcactcagccgaacgaccgagcgcagcgagtcagtgagcgaggaagcggaagagcgcccaatacgcggagacctcaagaacgcaatcccacctcactgcttcaaacgctccatcccacgctccttctcctcttcgacatcatcatctcctcctcggctcctccctctaccacctctccacagcctacttccctctccccccccaccctctcccttacctcgcctggcccctctactgggcctgccaaggctgcgtcctaacgggcctctgggtcatcgcccacgaatgcggccaccacgccttcagcgactac

SEQ ID NO: 36550 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36551 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttgcctcgcctggcccctctactgggcctgccaagggtgcgtcctcacgggcctctgggtcatagcccacgagtgcggccaccacgccttcagcgactac

SEQ ID NO: 36552 - DNA, 317 bp, Artificial
  Mutation in BnaC.FAD2.b introduced by TALE nuclease pair BnFAD2_T03
caggatccatgggtgcaggtggaagaatgcaagtatatcctccctccagctcacccgaaaccaaaaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36553 - DNA, 333 bp, Artificial
  Mutation in BnaC.FAD2.b introduced by TALE nuclease pair BnFAD2_T03
caggatccatgggtgcaggtggaagaatgcaagtctctcctccctccagctaccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctcccacctctccacagcctccttccctatcccttacctcgcctgacccctctactgggcctgccaaggctgcgtcctaacgggcctctgggtcatagcccacgagtgcggccaccacgccttcagcgactac

SEQ ID NO: 36554 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcacttaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36555 - DNA, 358 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagcggctgttgccggtgctgtgccaggcccccgctcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36556 - DNA, 365 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggttccatagcgttaaggtttcatttagcgcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36557 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctagcaggcgctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 36558 - DNA, 333 bp, Artificial
  Mutation in BnaC.FAD2.b introduced by TALE nuclease pair BnFAD2_T03
caggatccatgggtgcaggtcgaagaatgcaagtctctcctccctccagctcccccggaaccaacaccctcaaacgcgtcccctgcgagacaccacaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36559 - DNA, 481 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactcacacctccatcaagcaatcccacctcactgcttcaaacgctccatcccacgctccttcttcccctcgccatcatcatctcctcctcggctcctccctccaccacctccccacagcctccttccctcctccgcacccccccacacccaaacccaaccaaagcaatcccaccccacacccccacccgctccatcccaccctccttcccctcttcgacatcaccaccccctcctcggctcctcccccgcccacctccccacagcctcctaccctctcccttacctcgcctggcccctctactgggcctgccaaggctgcgtcctaacgggcctctgggtcatcgcccacgaatgcggccaccacgccttcagcgactac

SEQ ID NO: 36560 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaacctcaagaaagcaatcccacctcactgcttcaaacgctacatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36561 - DNA, 337 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtcccctgcgagacaccaccattcactctagaacctcaagaaagcaatcccacctcactgcttcaaacgctccatcccacgctccttctcctcttcgacatcatcatctcctcctcggctcctccctctaccacctctccacagcctacttccctctcccttacttcgcctggcctctctactgggcctgccagggctgcgtcctaaccggcgtctgggtcatagcccacgagtgcggccaccacgccttcagcgactac

SEQ ID NO: 36562 - DNA, 296 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccatcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcttccaccacgccatcagcgactac

SEQ ID NO: 36563 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36564 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36565 - DNA, 416 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagcgcctgctgccggtgctgtgccaggcccacggcttgaccccccagcaggtggtggccatcgccagcaataatggtggcagacctcaagaaagcaatcccacctcactgcttcaaacgctccatcccacgctccttctcctcttcgacatcagcacctcctcctcggctcctccctctaccacctctccacagcctacttccctcgcccttacctcgcctggcccctctacggggcctgccaaggctgcgtcctaacgggcctctgggtcatcgctcacgaatgcggccaccacgccttcagcgactac

SEQ ID NO: 36566 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgaacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctgacccctctactgggcctgccaaggctgcgtcctaacgggcctctgggtcatcgcccacgaatgcggccaccacgccttcagcgactac

SEQ ID NO: 36567 - DNA, 427 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacagcaccggcaacagccgctggaccgtctccagcgcctgcttgccaccgccaagccgtgggcctggcacagcaccggcaacagccgctggacgacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36568 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatccctcgctccttcgcctacctcctcttcgacatcctcgtctcctcctccctctaccacctctccacagcctacttccctctcctccccccccctctcccttacctcacctggcccctctactgggcctgccaaggctgcgtcctaacgggcctctgggtcatagcccacgagtgcggccaccacgccttcagcgactac

SEQ ID NO: 36569 - DNA, 305 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacaattcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgtggccaccacgccttcagcgactac

SEQ ID NO: 36570 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctattcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36571 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcacacgagtgcggccaccacgccttcagcgactac

SEQ ID NO: 36572 - DNA, 421 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttccagcgcctgcttgccaccattattgctggcgatggccaccacctgctgggggtcaagccgtgggcctggcacagcaccggcggagacctcaagaaagcaatcccacctcactgcttcaaacgctccatcccacgctccttctcccctccgacaccatcacctcctcctcggctcctccccctcccacctccccacagcctacttccctctcccttacctcgcctgacccctctactgggcctgccaaggctgcgtcctaacgggcctctgggtcatagcccacgagtgcggccaccacgccttcagcgactac

SEQ ID NO: 36573 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36574 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcggcctaacgggcctctgggtcatcgcccacgaatgtggccaccacgccttcagcgactac

SEQ ID NO: 36575 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36576 - DNA, 404 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctctgacttgagcgtcgatttttgtgatgctcgtcagggggggccatcgccagcaatggcggcggcaggccggcgctggaacctcaagaaagcaatcccacctcactgcttcaaacgctccatcccacgctccttctcctcttcgacatcatcatctcctcctcggctcctccctctaccacctctccacagcctacttccctctcccttccctcgcctgacccctctactgggcctgccaaggctgcgccctaacgggcctctgggtcatagcccacgagtgcggccaccacgccttcagcgactac

SEQ ID NO: 36577 - DNA, 377 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtccccctgcgagacaccacaccgcccgccataaactgccaggcatcaaacagcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcatgccaaggctgcgtcctaacgggcctctgggtcatcgcccacgaatgcggccaccacgccttcagcgactac

SEQ ID NO: 36578 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatcgcccacgaatgcggccaccacgccttcagcgactac

SEQ ID NO: 36579 - DNA, 416 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctagcgcctgctgccggtgctgtgccaggcccacggcttgaccccccagcaggtggtggccatcgccagcaataatggtggcagacctcaagaaagcaatcccacctcactgcttcaaacgctccatcccacgctccttctcctcttcgacatcatcacctcctcctcggctcctccctctaccacctctacacagcctacttccctctccctaacctcgcctgacccctctactgggcctgccaaggctgcgtcctaacgggcctctgggtcatagcccacgagtgtggccaccacgccttcagcgactac

SEQ ID NO: 36580 - DNA, 335 bp, Artificial
  Mutation in BnaC.FAD2.b introduced by TALE nuclease pair BnFAD2_T03
caggatccatgggtgcaggtggcagaatgcaagtgtctactccctccaaaaagtctgaaaccgacaacatcaagcgcgtaccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36581 - DNA, 335 bp, Artificial
  Mutation in BnaC.FAD2.b introduced by TALE nuclease pair BnFAD2_T03
caggatccatgggtgcaggtggcagaatgcaagtgtctcctccctccaaaaagtctgaaaccgacaacatcaagcgcgtaccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36582 - DNA, 387 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttgaccccggagcaggtggtggccatcgccagccacgatggcggcaagcaggcgacctcaagaaagcaatcccacctcactgcttcaaacgctccatcccacgctccttctcctcttcgacatcatcatctcctcctcggctcctccccctcccacctccccacaccctacttccctctcccttacctcgcctgacccctctactgggcctgccaaggctgcgtcctaacgggcctctgggtcatagcccacgagtgcggccaccacgccttcagcgactac

SEQ ID NO: 36583 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36584 - DNA, 379 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggttccatagcgttaaggtttcatttagcgcctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcatcgactac

SEQ ID NO: 36585 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcatacttccctctcccttacctcgcctgacccctctactgggcctgccaaggctgcgtcctaacgggcctctgggtcatagcccacgagtgcggccaccacgccttcagcgactac

SEQ ID NO: 36586 - DNA, 326 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccaccattctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36587 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36588 - DNA, 350 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgtgtcatcgcccacgaatgcggccaccacgccttcatcgactac

SEQ ID NO: 36589 - DNA, 363 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgcggcgggtgtggtggatacgcgcaaagaccgcaagaaagcaatcccacctcactgcttcaaacgctccatcccacgctccttcccctcttcgacatcatcatctcctcctcggctcctccctctaccacctctccacagcctacttccctctcccttacctcgcctgacccctctactgagcctgccaaggctgcgtcctaacgggcctctgggtcatcgcccacgagtgcggccaccacgccttcagcgactac

SEQ ID NO: 36590 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccatcagcgactac

SEQ ID NO: 36591 - DNA, 335 bp, Artificial
  Mutation in BnaC.FAD2.b introduced by TALE nuclease pair BnFAD2_T03
caggatccatgggtgcaggtggcagaatgcaagtctctactccatccagctcccccggaaccaacaccctcaaacgcgtcccctgcgagacaccaccattcactaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcctgcagcgactac

SEQ ID NO: 36592 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 36593 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccatcagcgactac

SEQ ID NO: 36594 - DNA, 330 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacaccaccattcgacctcaagaaagcaatcccacctcactgcttcaaacgctccatcccacgctccttctcctcttcgacatcatcatctcctcctcggctcctccctccaccacctctccacagcctacttccctctcccttgcctcgcctgacccctctactgggcctgccaaggctgcgtcctaacgggcctctgggtcatagcccacgagtgcggccaccacgccttcagcgactac

SEQ ID NO: 36595 - DNA, 350 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtccgaacgggcctctgggtcatcgcccacgaatgcggccaccacgccttcagcgactac

SEQ ID NO: 36596 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 36597 - DNA, 410 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttgcgtagattttcaggtttaacgtcagatgaatatacagtcacagtacccttaacatcagagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36598 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36599 - DNA, 294 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccgtcagcgactac

SEQ ID NO: 36600 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36601 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 36602 - DNA, 385 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcaccggcaacagccgctggaccgtctccagcgcctgcttgccaccagagacctcaagaaagcaatcccacctcactgcttcaaacgctccatccctcgctccttctcctacctcctcttcgacatcctcgtctcctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36603 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36604 - DNA, 335 bp, Artificial
  Mutation in BnaC.FAD2.b introduced by TALE nuclease pair BnFAD2_T03
caggatccatgggtgcaggtggaagaatgcaagtctatcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36605 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggtcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36606 - DNA, 335 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36607 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 36608 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 36609 - DNA, 321 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagcggagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36610 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcacaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36611 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 36612 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctccactgggcctgccaaggctgcgtcctaacgggcctctgggtcatagcccacgagtgcggccaccacgccttcagcgactac

SEQ ID NO: 36613 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgggacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtctgaacgggcctcggggtcatcgcccacgaatgcggccaccacgccttcagcgactac

SEQ ID NO: 36614 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 36615 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaacctcaaacgcgtcccctgcgagacaccaccacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36616 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcacctcaagaaagcaatcccacctcactgcttcaaacgctccatcccacgctccttctcctcttcgacatcatcatctcctcctcggctcctccatctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36617 - DNA, 351 bp, Artificial
  Mutation in BnaC.FAD2.b introduced by TALE nuclease pair BnFAD2_T03
caggatccatgggtgcaggtggaagaatgcaagtctctcctccctccagctccccaggaaccaacaccctcaaacgcgtcccctgcgagacaccaccattcactctcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36618 - DNA, 334 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36619 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36620 - DNA, 419 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaggataaaattgtagctgggtgcaaaatagcaactaatcttgatttaaggcttcaaaacctcccgcaagtcgggaggttcggagacctcaagaaagcaatcccacctcactgcttcaaacgctccatcccacgctccttctcctcttcgacatcatcatctcctcctcggctcctccccctcccacctctccacagcctccttccctctcccttccctcgcctgacccctctactgggcctgccaaggctgcgtcctaacgggcctctgggtcatagcccacgagtgcggccaccacgccttcagcgactac

SEQ ID NO: 36621 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgctccaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36622 - DNA, 345 bp, Artificial
  Mutation in BnaC.FAD2.b introduced by TALE nuclease pair BnFAD2_T03
caggatccatgggtgcaggtggaagaatgcaagtgtgtcctccctccaaaaagtctgaaaacgacaccatcaagcgcgtaccctgcgagacaccgcccttcacgcctcaagaaagcaatcccaccgcactgcttcaaacgctccatccctcgctccttctcctacctcctcttcgacatcctcgtctcctcctccctctaccacctctccacagcctacttccctctcctcccccaccctctcccttccctcgcctggcccctctaccgggcctgccaaggctgcgtcctaacgggcctctgggtcatcgcccacgaatgcggccaccacgccatcagcgactac

SEQ ID NO: 36623 - DNA, 349 bp, Artificial
  Mutation in BnaC.FAD2.b introduced by TALE nuclease pair BnFAD2_T03
caggatccatgggtgcaggtggaagaatgaaagtctctcctccctccagctcccccgaaaccaaaaccctcaaacgcgtcccctgcgagacaccacccttcactaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36624 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36625 - DNA, 335 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36626 - DNA, 349 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 36627 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 36628 - DNA, 337 bp, Artificial
  Mutation in BnaC.FAD2.b introduced by TALE nuclease pair BnFAD2_T03
caggatccatgggtgcaggtggaagaatgcaagtctctcctccctccagctccccgaaaccaaaaccctcaaacgcgtcccctgcgagacaccacccttcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36629 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccagacctcaagaaagcaatcccacctcactgcttcaaacgctccttcccaccctccttctcctcttccacatcatcatctcctcctcggctcctccctctaccacctctcctcagcccacttccctctcccttacctcgcctgacccctctactgggcctgccaaggctgcgtcctaaccggcgtctgggtcatagcccacgagtgcggccaccacgccttcagcgactac

SEQ ID NO: 36630 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccagacctcaagaaagcaatcccacctcactgcttcaaacgctccatcccaccctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 36631 - DNA, 342 bp, Artificial
  Mutation in BnaC.FAD2.b introduced by TALE nuclease pair BnFAD2_T03
caggatccatgggtgcaggtggcagaatgcaagtctctactccctcccgctcccccggaaccaacaccctcaaacgcgtcccctgcgagacaccaccattcactgagacctcaagaaagcaatcccacctcactgcttcaaacgctccatcccacgctccttctcctacctcctcttcgacatcatcatctcctcctcggctcctccctctaccacctctccacagcctacttccctctcccttccctcgcctggcccctctactgggcctgccaaggctgcgtcctaacgggcctctgtgtcatcgcccacgaatgcgtcctcctcgccttcagcgactac

SEQ ID NO: 36632 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctacctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 36633 - DNA, 335 bp, Artificial
  Mutation in BnaC.FAD2.b introduced by TALE nuclease pair BnFAD2_T03
caggatccatgggtgcaggtggaagaatgcaagtgtctcacccctccaagaagtctgaaaccgacaccatcaagcgcgtaccctgcgagacaccacccttcactgagacctcaagaaagcaatcccacctcactgcttcaaacgctccatcacacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36634 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactccatcccacgctccttctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36635 - DNA, 416 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttcgtacggctccgcagtggatggcgcaatgcactgacgggtgccccgctcaacttgaccccccagcagacctcaagaaagcaatcccacctcactgcttcaaacgctccatccctcgctccttctcctacctcctcttcgacatcctcgtctcctcctccctctaccccctctccacagcctacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 36636 - DNA, 339 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccctttcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 36637 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagcctgcgtcctaacgggcctctgggtcatcgcccacgaatgcggccaccacgccttcagcgactac

SEQ ID NO: 36638 - DNA, 330 bp, Artificial
  Mutation in BnaC.FAD2.b introduced by TALE nuclease pair BnFAD2_T03
caggatccatgggtgcaggtggaagaatgcaagtatctactccctccagctcccccggaaccaacaccctcaaacgcgtcccctgcgagacaccaccattccccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctccgaaggctcctccctaacgggcttcttggccatcgcccaggtgtgcgtcctccgccccagcaacgactgc

SEQ ID NO: 36639 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36640 - DNA, 349 bp, Artificial
  Mutation in BnaC.FAD2.b introduced by TALE nuclease pair BnFAD2_T03
caggatccatgggtgcaggtggaagaatgcaagtctctcctccctccagctccaccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 36641 - DNA, 394 bp, Artificial
  Mutation in BnaC.FAD2.b introduced by TALE nuclease pair BnFAD2_T03
caggatccatgggtgcaggtggaagaatgcaagtctctcctccctccagctcccctggaaccaacaccctcaaacgcgtcccctgcgagacaccaccattcactcttggccaccacctgctccggggtcaagctggaggggtacaccttccaccactcgttgggagacctcaagaaagcaatcccacctcactgcttcaaacgctccatcccacgctccttctcctcttcgacatcatcatctcctcctcggctcctccctctcccccctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36642 - DNA, 411 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggagcaggtggtggccatcgccagcaatattggtggcaagcaggcgctggagacggtgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccgaggctgcgtcctaacgggcctctgggtcatcgcccacgaatgcggccaccacgccttcagcgactac

SEQ ID NO: 36643 - DNA, 367 bp, Artificial
  Mutation in BnaC.FAD2.b introduced by TALE nuclease pair BnFAD2_T03
caggatccatggggtgcaggtggaagaatgcaagtgtctcctccctccaaaaagtctgaaaccgacaacatcaagcgcgtaccctgcgagacaccgccattcactatcaggggataacgcaggaaagaacatgtgagcaaaaggccagcaaatctaccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36644 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggcggcgtcctaacgggcctctgggtcatagcccacgagtgcggccaccacgccatcagcgactac

SEQ ID NO: 36645 - DNA, 279 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcttcgacatcctcgtctcctcctccctctaccacctctccacagcctacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 36646 - DNA, 279 bp, Artificial
  Mutation in BnaC.FAD2.b introduced by TALE nuclease pair BnFAD2_T03
caggatccatgggtgcaggtggaagaatgcaagtctctcctccctccagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactggtcctgccaaggctgcgtcctaacgtgcctctgggtcatcgcccacgaatgcggccaccactccatcagcgactac

SEQ ID NO: 36647 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcagggtcaagccgtgggcctggcacagcaccggcaacaggagacctcaagaaagcaatcccacctcactgcttcaaacgctccatcccacgctccttctcctcttcgacatcatcatctcctcctcggctcctccctcaccctctctcctacttcgcctggcctctctactgggcctgccaagggtgcgtcctaacgggcctctgggtcatcgcccacgaatgcggccaccacgccttcagcgactac

SEQ ID NO: 36648 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcacttcttcaaacgccccatccctcgctccttctcctacctcctcttcgacatcctcgtctcctcctccctctaccacctctccacagcctacttccctctcctcccccaccctctcccttaccccgcctggcccctctactgggccggccaaggctgcgtcctaacgggcctctgggtcatcgcccacgaatgcggccaccacgccttagcgactac

SEQ ID NO: 36649 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacggtcctctgggtcatagcccacgagtgcggccaccacgccttcagcgactac

SEQ ID NO: 36650 - DNA, 330 bp, Artificial
  Mutation in BnaC.FAD2.b introduced by TALE nuclease pair BnFAD2_T03
caggatccatgggtgcaggtggaagaatgcaagtttctccttccttcagctcccccggaaccaacaccctcaaacgcgtcccctgcgagacaccaccattcgacctcaagaaagcaatcccacctcactgcttcaaacgctccatcccaccctccttctcctcttcgacatcatcatctcctcctcggctcctccctctaccacctctccacagcctacttccctctcccttacctcgcctgacccctctactgggccggccaaggctgcgtcctaacgggcctctgggtcatagcccacgagtgcggccaccacgccttcagcgactac

SEQ ID NO: 36651 - DNA, 338 bp, Artificial
  Mutation in BnaC.FAD2.b introduced by TALE nuclease pair BnFAD2_T03
caggatccatgggtgcaggtggaagaatgcaagtgtctaatccctccaaaaagtctgaaaccgacaacatcaagcgcgtaccctgcgagacaccgccctttagaactcaagaaagcaatcccacctcactgcttcaaacgctccatcccacgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatctcccgcgaatgcggccaccacgccatcagcgactac

SEQ ID NO: 36652 - DNA, 278 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36653 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaactcctccctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36654 - DNA, 309 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 36655 - DNA, 347 bp, Artificial
  Mutation in BnaC.FAD2.b introduced by TALE nuclease pair BnFAD2_T03
caggatccatgggtgcaggtggaagaatgcaagtctctcctccctccagctccccggaaccaacaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 36656 - DNA, 370 bp, Artificial
  Mutation in BnaC.FAD2.b introduced by TALE nuclease pair BnFAD2_T03
caggatccatgggtgcaggtggaagaatgcaagtctcccctccctccagctcccccggaaccaacaccctcaaacgcgtcccctgcgagacaccaccattcggggtcaagccgtgggcctggcacagcaccggcaacaggagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccagggctgcggcctaaccggcgtctgggtcatcgcccgcgaatgcggccaccacgcctgcagcgactgc

SEQ ID NO: 36657 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36658 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccatcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggccggccaaggctgcgtcctaacgggcctctgggtcatcgcccacgaatgcggccaccacgccttcagcgactac

SEQ ID NO: 36659 - DNA, 333 bp, Artificial
  Mutation in BnaC.FAD2.b introduced by TALE nuclease pair BnFAD2_T03
caggatctgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 36660 - DNA, 335 bp, Artificial
  Mutation in BnaC.FAD2.b introduced by TALE nuclease pair BnFAD2_T03
caggatccatgggtgcaggtggaagaatgcaagtgtctcctccctcaaagaagtctgaaaccgacaccatcaagcgcgtaccctgcgagacaccgcccttcacttagaactcaagaaagcaatcccaccgcactgcttcaaacgctccatcccacgctccttctcctcttcgacatcatcatctcctcctcggctcctccctctaccacctctccacagcctacttccatctcccttacctcgcctgacccctctactgggcctgccaaggctgcgtcctaacgggcctctgggtcatagcccacgagtgcggccaccacgccttcagcgactac

SEQ ID NO: 36661 - DNA, 331 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcagacctcaagaaagcaatcccacctcactgcttcaaacgctccatcccacgctccttctcctcttcgacaccatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36662 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccaacaccctcaaacgcgtcccctgcgagacaccaccattcactctcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36663 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagaacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36664 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccactaatgcggccaccacgccttcagcgactac

SEQ ID NO: 36665 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccaaagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36666 - DNA, 347 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 36667 - DNA, 337 bp, Artificial
  Mutation in BnaC.FAD2.b introduced by TALE nuclease pair BnFAD2_T03
caggatccatgggtgcaggtggaagaatgcaagtatctcctccctccagctcccccgaaaccaaaaccctcaaacgcgtcccctgcgagacaccacccttaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccatcagcgactac

SEQ ID NO: 36668 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccattcctcgctccttctcctacctcctcttcgacatcctcgtctcctcctccctctaccacctctccacagcctacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 36669 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctcccaagggtgcgtcctaaccggcgtctgggtcatagcccacgagtgcggccaccacgccttcagcgactac

SEQ ID NO: 36670 - DNA, 367 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcatcaaactaagcagaaggccatccgtcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36671 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 36672 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacagggcctgccagggctgcgtcctaacgggcctctgggtcatagcccacgagtgcggccaccacgccttcagcgactac

SEQ ID NO: 36673 - DNA, 401 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttgcccgccaccctccgggccgttgcttcacaacgttcaaatccgctcccggagaactcaagaaagcaatcccacctcactgcttcaaacgctccatccctcgctccttctcctacctcctcttcgccatcctcgtctcctcctccctctaccacctctccacagcctacttccctctcctcccccaccctctccctttcctcgcctggcccctctactgggcctgccaaggctgcgtcctaacgggcctctgggtcatcgcccacgaatgcggccaccacgccttcagcgactac

SEQ ID NO: 36674 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 36675 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcgagacctcaagaaatcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36676 - DNA, 319 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36677 - DNA, 329 bp, Artificial
  Mutation in BnaC.FAD2.b introduced by TALE nuclease pair BnFAD2_T03
caggatccatgggtgcaggtggaagaatgcaagtatctcctccctccagctcccccgaaaccaaaaccctcaaacgcgtcccctgcgagacaccacccttagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36678 - DNA, 370 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcggggtcaagccgtgggcctggcacagcaccggcaacaggagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 36679 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 36680 - DNA, 381 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggagagcgttcaccgacaaacaacagataaaacgaaaggcccagtcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36681 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36682 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagaaaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36683 - DNA, 340 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccaactcaagaaagcaatcccaccgcaatgtttcaaacgctcgatccctcgctctttctcctacctcctcttcgacatcctcgtctcctcctccctctaccacctctccacagcctacttccctctcctccccccccctcccccttacctcgcctggcccctctactgggcctgccatggctgcgtcctaacgggcctctgggtcatcgcccgcgaatgcggccaccacgcctgcagcgactac

SEQ ID NO: 36684 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccacgaaaccaaaaccctcaaacgcgtcccctgcgagacaccacccttcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36685 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcacctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36686 - DNA, 333 bp, Artificial
  Mutation in BnaC.FAD2.b introduced by TALE nuclease pair BnFAD2_T03
caggatccatgggtgcaggcggaagaatgcaagtgtctcctccctccaagaagtctgaaaccgacaccatcaagcgcgtaccctgcgagacaccgcccttcactgtactcaagaaagcaatcccacctcactgcttcaaacgctccatcccacgctccttctcctcttcgacatcatcatctcctcctcggctcctccctccaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36687 - DNA, 431 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactctcggctgttgccggtgctgtgccaggcccacggcttgaccccccagcaggtggtggccatcgccagcaatggcggtggcaagcaggcgctggagacggacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36688 - DNA, 314 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36689 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36690 - DNA, 302 bp, Artificial
  Mutation in BnaC.FAD2.b introduced by TALE nuclease pair BnFAD2_T03
caggatccatgggtgcaggtggaagaatgcaagtctctcctccaccaacaccctcaaacgcgtcccctgcgagacaccaccattcactctcgggagacctcaagaaagcaatcccacctcactgcttcaaacgctccatcccacgctccttctcctcttcgacatcatcatctcctcctcggctcctcccccaccctctcccttacctcgcctggcccctctactgggcctgccaaggctgcgtcctaacgggcctctgggtcatagcccacgagtgcggccaccacgccttcagcgactac

SEQ ID NO: 36691 - DNA, 306 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacttggcctgccaaggctgcgtcctaacgggcctctgggtcatcgcccacgaatgcggccaccacgccttcagcgactac

SEQ ID NO: 36692 - DNA, 348 bp, Artificial
  Mutation in BnaC.FAD2.b introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtcctcaagaaagcaatcccacctcattgcttcaaacgctccatcccacgctccttctcctcttcgacatcatcatctcctcctcggctcctccctctaccacctctccacagcctacttccctctcctcccccaccctctcccttacttcgcctggcctctctactgggcctgccaagggtgcgtcctaacgggcctctgggtcatagcccacgagtgcggccaccacgccttcagcgactac

SEQ ID NO: 36693 - DNA, 356 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaaacgcgtcccctgcgagacaccacccttcactctcggcggagacctcaagacagcaatcccacctcactgcttcaaacgctccatccctcgctccttctcctacctcctcttcgacatcctcgtctcctcctccctctaccacctctccacagcctacttccctctcctcccccaccctctccctttcctcgcctggcctctctactgggccggccaagggtgcgtcctaaccggcgtctgggtcatagcccaccaatgcggccaccacgccttcagcgactac

SEQ ID NO: 36694 - DNA, 340 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccacccttcactctaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36695 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccgacaccctcaaacgcgtcccctgcgagacaccacccttcactcagacctcaagaaagcaatcccacctcactgcttcaaacgctccatccctcgctccttctcctacctcctcttcgacatcctagtctcctcctccctctaccacctctccacagcctacttccctctcctcccccaccatctcccttacctcgcctggccactctactgggcctgccaaggctgcgtcctaacgggcctctgggtcatcgcccacgaatgcggccaccacgccttcagcgactac

SEQ ID NO: 36696 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccttccaaggctgcgtcctaacgggcctctgggtcatatcccacgagtgcggccaccacgccttcagcgactac

SEQ ID NO: 36697 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36698 - DNA, 472 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcatcatataatttctgttgaattacgttaagcatgtaataattgatggccagcaatattggtggcaagcaggcgctggagacggtgcaggcgctgttgccggtgctgtgccaggcccacggcttgacctcaagaaagcaatcccacctcactgcttcaaacgctccatcccacgctccttctcctcttcgacatcatcatctcctcctcggctcctccctctaccacctctccacagcctacttccctctcctcccccacactctcccttacctcgcctggcccctctactgggcctgccaaggctgcgtcctaacgggcctctgggtcatcgcccacgaatgcggccaccacgccttcagcgactac

SEQ ID NO: 36699 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatgctccttaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgaatgcggccaccacgccttcagcgactac

SEQ ID NO: 36700 - DNA, 269 bp, Artificial
  Mutation in BnaC.FAD2.b introduced by TALE nuclease pair BnFAD2_T03
caggatccatgggtgcaggtggaagaatgcaagtgtctcctccctcaagaaagcaatcccaccgcactgtttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36701 - DNA, 347 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccacctcactgcttcaaacgctccatccctcgctccttctcctacctccgcttcgacatcctcgtctcctcctccctctaccacctctccacagcctacttccctctcctcccccaccctctcccttacctcgccgggcccctctactgggcctgccaaggcggcgtcctaacgggcctctgggtcatcgcccacgaatgcggccaccacgccttcagcgactac

SEQ ID NO: 36702 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 36703 - DNA, 335 bp, Artificial
  Mutation in BnaC.FAD2.b introduced by TALE nuclease pair BnFAD2_T03
caggatccatgggtgcaggtggaagaatgcaagtctctcctcactccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36704 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 36705 - DNA, 335 bp, Artificial
  Mutation in BnaC.FAD2.b introduced by TALE nuclease pair BnFAD2_T03
caggatccatgggtgcaggtggaagaatgaaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctaccgggcctgccaaggctgggtcctaacgggcctctgggtcatagcccacgagtgcggccaccacgccttcagcgactac

SEQ ID NO: 36706 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 36707 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36708 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 36709 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36710 - DNA, 321 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36711 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcacacgagtgcggccaccacgccttcagcgactac

SEQ ID NO: 36712 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccacctcactgcttcaaacgctccatcccacgctccttctcatcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36713 - DNA, 295 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatctcccacgaatgcggccaccacgccttcagcgactac

SEQ ID NO: 36714 - DNA, 347 bp, Artificial
  Mutation in BnaC.FAD2.b introduced by TALE nuclease pair BnFAD2_T03
caggatccatgggtgcaggtggaagaatgcaagtatctcctcccttcagctccgccgaaaccaaaaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccccccccctttccccccctggcccctctactgggcctgccaaggctgcgtcctaacgcgcctctgggtcatctcccgcaaatgcttccaccacaccatcagcaactac

SEQ ID NO: 36715 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 36716 - DNA, 294 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36717 - DNA, 348 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacccttcactagacctcaagaaagcaatcacacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36718 - DNA, 345 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36719 - DNA, 354 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgattgtagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36720 - DNA, 419 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcaacagccgctggaccgtctccagcgcctgcttgccaccattattgctggcgatggccaccacctgccatcccacgttccagacctcaagaaagcaatcccacctcactgcttcaaacgctccatcccacgctccttctcctctccgacatcatcatcccctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36721 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacatgagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccagggctgcgtcctaaccggcgtctgggtcatagcccacgagtgcggccaccacgccttcagcgactac

SEQ ID NO: 36722 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgccccatccctcgctccttctcctacctcctcttcgacatcctcgtctcctcctccctctaccacctctccacagcctacttccctctcctcccccaccctctccattacctcgcctggcccctctactgggcctgccaaggctgcgtcctaacgggcctctgggtcatcgcccacgaatgcggccaccacgccttcagcgactac

SEQ ID NO: 36723 - DNA, 351 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagacaccacccttcactctagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaagggtgcgtactaaccggcgtctgggtcatagcccacgagtgcggccaccacgccttcagcgactac

SEQ ID NO: 36724 - DNA, 336 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccaccattcacatgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36725 - DNA, 322 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaaccgcgccccccgttatcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36726 - DNA, 345 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcacacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36727 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagtgactac

SEQ ID NO: 36728 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcctccgaaaccaacaccctcaaacgcgtcccctgcgagacaccaccattcactcacctcaagaaagcaatcccaactcactccttcaaacgctccatcccacgccccttctcctcttccacatcctcctcgcctcctcggctcccccccctcccacctccccccaccctacttccctctcccctacctcgcctgacccctctactgggcctgccaaggctgcgtcctaacgggcctctgggtcatagcccacgagtgcggccaccacgccttcagcgactac

SEQ ID NO: 36729 - DNA, 337 bp, Artificial
  Mutation in BnaC.FAD2.b introduced by TALE nuclease pair BnFAD2_T03
caggatccatgggtgcaggtggaagaatgcaagtctcacctccctccagctcccccggaaccaacaccctcaaacgcgtcccctgcgagacaccaccattcactctaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36730 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacggggcctgccaaggctgcgtcctaacgggcctctgggtcatcgcccacgaatgcggccaccacgccttcagcgactac

SEQ ID NO: 36731 - DNA, 394 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccagaacgggtagtgaattgcgcttgagatggtttaatttcaactttaatcattattgaattccctcgggtttcccacctcactgcttcaaacgctccatccctcgctccttctcctacctcctcttcgacatcctcgtctcctcctccctctaccacctccccacagcctacttccctccccccccccaccctctcccttccctcccctggcccctctacggggcctgccaaggctgcgtccaaacgggcctctgggtcatcgcccacgaatgcggccaccacgccttcagcgactac

SEQ ID NO: 36732 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcttcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36733 - DNA, 305 bp, Artificial
  Mutation in BnaC.FAD2.b introduced by TALE nuclease pair BnFAD2_T03
caggatccatgggtgcagggggaagaatgcaagtctctcctccctccagctcccccggaaccaacaccctcaaacgcgtcccctccgagacaccaccattcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36734 - DNA, 304 bp, Artificial
  Mutation in BnaC.FAD2.b introduced by TALE nuclease pair BnFAD2_T03
caggatccatgggtgcaggtgcaagaatgcaagtctctcctccctccagctcccccgaaaccaaaaccctcaaacgcgtcccctgcgagacaccacccttcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36735 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcggagacctcaagaaagcaatcccacctcactgcttcaaacgctccatccctcgctccttctcctacctcctcttcgacatcctcgtctcctcctccctctaccacctctccacagcctacttccctctcctccaccaccctctcccttacctcgcctgacccctctactgggcctgccaaggctgcgtcctaacgggcctctgggtcatagcccacgagtgcggccaccacgccttcagcgactac

SEQ ID NO: 36736 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36737 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtccccacgcgtcccagcaatggcggtggcaagcaggcgctggagacctcaagaaagcaatcccacctcactgcttcaaacgctccatcccacactccttctcctcttcgacatcatcatctcctcctcgtctcctccctctaccacctctccacagcctacttccctctccctgacctcgcctgacccctctactgggcctgccaaggctgcgtcctaacgggcctctgggtcatagcccacgagtgcggccaccacgccttcagcgactac

SEQ ID NO: 36738 - DNA, 377 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtccccctgcgagacaccacaccgcccgccataaactgccaggcatcaaacagcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcatgccaaggctgcgtcctaacgggcctctgggtcatcgccctcgaatgcggccaccacgccttcagcgactac

SEQ ID NO: 36739 - DNA, 423 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcgacttcgctgctacccaaggttgccccacgagtacatcgagctgatcgagatcgcccggaacagcacccaagagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36740 - DNA, 334 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36741 - DNA, 399 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcggatggcctttttgcgtttctacaaactcttcctggctagcggtactcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36742 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36743 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttagcgactac

SEQ ID NO: 36744 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 36745 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcttgaaagcaatcccacctcactgcttcaaacgctccatccctcgctccttctcctacctcctcttcgacatcctcgtctcctcctccctctaccacctctccacagcctacttccctctcctcccccaccctctcccttacctcgtctggcccctctactgggcctgccaaggctgcgtcctaacgggcctctgggtcatcgcccacgaatgcggccaccacgccttcagcgactac

SEQ ID NO: 36746 - DNA, 345 bp, Artificial
  Mutation in BnaC.FAD2.b introduced by TALE nuclease pair BnFAD2_T03
caggatccatgggtgcaggtggaagaatgcaagtctcttctcccttccgctcccccgaaaccaaaaccctcaaccgcgtcccctgcgagacaccacccataagacctcaagaaagcaatcccacctcactgcttcaaacgccccatccctcgctccttctcctacctcctcttcgacatcctcgtctcctcctccctctaccacctctccacaacctacttccctctcctcccccaccctctcccttacctcgcctggcccctctactgggccggccaaggctgcgtcctaacgggcctctgggtcagcgcgctcgaatgcggccaccacgccatcagcgactac

SEQ ID NO: 36747 - DNA, 395 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggccttctgcttagtttgatgcctggcagtttatggcgggcataagacctcaagaaagcaatcccacctcactgcttcaaacgctccatccctcgctccttctcctaccccctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36748 - DNA, 335 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36749 - DNA, 349 bp, Artificial
  Mutation in BnaC.FAD2.b introduced by TALE nuclease pair BnFAD2_T03
caggatccatgggtgcaggtggaagaatgcaagtacctactccctccagctccaccggaaccaacaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36750 - DNA, 395 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacattgaatcctgttgccggtcttgcgggactctaatcataaaaacccatctcataaataacgtagacctcaagaaagcaatcccacctcactgcttcaaacgctccatcccacgctccttctcctcttcgacatcatcatctcctcctcggctcctccctctaccacctctccacagcctacttccctctcccttacctcgcatgacccctctactgggcctgccaaggctgcgtcctaacgggcctctgggtcatagcccacgagtgcggccaccacgccttcagcgactac

SEQ ID NO: 36751 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36752 - DNA, 401 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggggggaaagccggcgaacgtggcgagaaaggaagggaagaaagcgaaaggagcgggcgctaggagacctcaagaaagcaatcccacctcactgcttcaaacgctccatcccacgctccttctcctcttcgacatcatcatctcctcctcggctcctccctctaccacctccccacagcctacttccctctcccttacctcgcctgacccctctactgggcctgccaaggctgcgtcctaacgggcctctgggtcatagcccacgagtgcggccaccacgccttcagcgactac

SEQ ID NO: 36753 - DNA, 365 bp, Artificial
  Mutation in BnaC.FAD2.b introduced by TALE nuclease pair BnFAD2_T03
caggatccatgggtgcaggtggaagaatgcaagtctctcctccctccagcttccccggaaccaacaccctcaaacgcgtcccctgcgagacaccaccattcactctcggctcttgatccggcaaaaaaaccaccgctacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36754 - DNA, 347 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctccatccctcgctccttctcctacctcctcttcgacatcctcgtctcctcctccctctaccacctctccacagcctacttccctctcctcccccaccctctcccttccctcgcctaacccctctactgggcctgccaaggctgcgtcctaacgggcctctgggtcatagcccacgagtgcggccaccacgccttcagcgactac

SEQ ID NO: 36755 - DNA, 347 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 36756 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaacctcaagaaaacaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36757 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 36758 - DNA, 347 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgactcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36759 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaacaaaaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36760 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttcccctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36761 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctttagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36762 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 36763 - DNA, 342 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacccttcactgagacctcaagaaagcaatcccacctcactgcttcaaacgctccatcccacgctccttctcctcttcgacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 36764 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36765 - DNA, 308 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36766 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36767 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36768 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctatccacagcctacttccctctcccttacctagcctgacccctctactgggcctgccaaggctgcgtcctaacgggcctctgggtcatagcccacgagtgcggccaccacgccttcagcgactac

SEQ ID NO: 36769 - DNA, 316 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaactcctccctcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaccgggcctctgggtcatagcccgcgagtgcggccaccacgccttcagcgactac

SEQ ID NO: 36770 - DNA, 334 bp, Artificial
  Mutation in BnaC.FAD2.b introduced by TALE nuclease pair BnFAD2_T03
caggatccatgggtgcagctgccagaatgcaagtgtctcctccctccaagaagcctgaaaccgacaccatcaagcgcgtaccccgcgagccaccgcccttcactcaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctagcgggcctctgggtcatagcgcacgagtgcggccagcacgcctttagcgactac

SEQ ID NO: 36771 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36772 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36773 - DNA, 347 bp, Artificial
  Mutation in BnaC.FAD2.b introduced by TALE nuclease pair BnFAD2_T03
caggatccattggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgacttc

SEQ ID NO: 36774 - DNA, 350 bp, Artificial
  Mutation in BnaC.FAD2.b introduced by TALE nuclease pair BnFAD2_T03
caggatccatgggtgcaggtggaagaatgcaagtccctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccgtcagcgactac

SEQ ID NO: 36775 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36776 - DNA, 365 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagacaccaccattcactctcggctcttgatccggcaaaaaaaccaccgctacctcaagaaagcaatcccacctcactgcttcaaacgctccatcccacgctccttctcctcttcgacatcatcatctcctcctcggctcctccctctaccacctctccacagcctacttccatctcccttacctcgcctgacccctctactgggcctgccaaggctgcgtcctaacgggcctctgggtcatagcccacgagtgcggccaccacgccttcagcgactac

SEQ ID NO: 36777 - DNA, 265 bp, Artificial
  Mutation in BnaC.FAD2.b introduced by TALE nuclease pair BnFAD2_T03
caggatccatgggtgcaggtggaagaatgcaagtctctcctccctccagtctctccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 36778 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctcacgggcctctgggtcatagcccacgagtgcggccaccacgccttcagcgactac

SEQ ID NO: 36779 - DNA, 405 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggtcagggtgccggcctttggtggcaagcaggcgctggagacggtccagcggctgttgccggtgcggagaactcaagaaagcaatcccaccgcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36780 - DNA, 375 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaacaccatcaacatcgtggctggcgatggccaccacctgtgccaggcccacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36781 - DNA, 448 bp, Artificial
  Mutation in BnaC.FAD2.b introduced by TALE nuclease pair BnFAD2_T03
caggatccatgggtgcaggtggaagaatgcaagtctctcctccctccagctcccccggaaccgacaccatcaagcgcgtaccctgcgagacaccccagcaggtggtggccatcgccagcaataatggtggcaagcaggcgctggagacggtgctgtgccaggcccacggcttgaccccccagcaggtggtggccatcgccagcaaaactcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36782 - DNA, 350 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36783 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36784 - DNA, 390 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctggtggccatcgccagcaatggcggtggcaacagccgctggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36785 - DNA, 336 bp, Artificial
  Mutation in BnaC.FAD2.b introduced by TALE nuclease pair BnFAD2_T03
caggatccatgggtgaggtggaagaatgcaagtctctcctccctccagctcccccggaaccaacaccatcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 36786 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccatgacagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36787 - DNA, 410 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaagcgcgtcccctgcgagacaccaccattcaccggagttgacctactcagaagaacgcccaccgacaaacaccagataaaacgccctccccagtcctccctcaagaaagcaatcccaccgcactgcttcaaacgctccatccctcgctcctcctcctacctcctcttcgacatccccgtcgcctcctccctctaccacgtcgccaccgcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 36788 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaaccccacctcactgctccaaacgctccaccccacgctccttctcctacctcctctcccccatcctcgtctcctcctccctctaccacccctccacatcctacttccctctccccccccaccctctcccttacctcgcctggcccctctactgggcctgccaaggctgcgtcctaacgggcctctgggtcatcgcccacgaatgcggccaccacgccttcagcgactac

SEQ ID NO: 36789 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36790 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36791 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36792 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 36793 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctccccccccctctcccttcccccgcctggcccctctacggggcctgccaaggctgcgtccaaacgggcctctgggtcatcgcccacgaatgcggccaccacgccttcagcgactac

SEQ ID NO: 36794 - DNA, 427 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacagcaccggcaacagccgctggaccgtctccagcgcctgcttgccaccgccaagccgtgggcctggcacagcaccggcaacagccgctggacgacctcaagaaagcaatcccacctcactgcttcaaacgctccatcccacgctccttctcctcttcgacatcatcatctcctcctcggctcctccctctcccacctctccacagcctacttccctctcccttacctcgcctgatccctctactgggcctgccaaggctgcgtcctaacgggcctctgggtcatagcccacgagtgcggccaccacgccttcagcgactac

SEQ ID NO: 36795 - DNA, 334 bp, Artificial
  Mutation in BnaC.FAD2.b introduced by TALE nuclease pair BnFAD2_T03
caggatccatgggagcaggtggaagaatgcaagtctctcctccctcccgctcccccggaaccaacaccctcaaccgcctcccccgcgagacaccaccattcactctacctcaagaaagcaatcccacctcactgcttccaacgctccctcccacgctccttctcctcttcgacatcatcatctcctcctcggctcctccctctaccacccctccacagcctacttccctctccctttcctcgcctgacccctctactgggccggccaaggctgcgtcctaacttgcctctgggtcagagagcatcagtgcggccactactccatcagcgactac

SEQ ID NO: 36796 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36797 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcttggtcatagcccacgagtgcggccaccacgccttcagcgactac

SEQ ID NO: 36798 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtaatagcccacgagtgcggccaccacgccttcagcgactac

SEQ ID NO: 36799 - DNA, 333 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagctcacgagtgcggccaccacgccttcagcgactac

SEQ ID NO: 36800 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggccggccaaggctgcgtcctaacgggcctctgggtcatcgcccacgaatgcggccaccacgccttcagcgactac

SEQ ID NO: 36801 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 36802 - DNA, 332 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactaactcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 36803 - DNA, 306 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgtgtcctaacgggcctctgggtcatcgcccacgaatgcggccaccacgccttcagcgactac

SEQ ID NO: 36804 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagacctcaagaaagcaatcccacctcactgcttcaaacgctccatcccaccctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36805 - DNA, 333 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36806 - DNA, 335 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctactcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36807 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccatcccacgctccttctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36808 - DNA, 348 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36809 - DNA, 362 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgcgatggcggcaagcaggcgctggagaagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36810 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgacctcaagaaagcaatcccacctcactgcttcaaacgctccatcccacgctccttctcctcttcgacatcatcatctcctcctcggctcctccctctaccacctctccacagcctacctccctctcccttacctcgcctgacccctctactgggcctgccaaggctgcgtcctaacgggcctctgggtcatagcccacgagtgcggccaccacgccttcagcgactac

SEQ ID NO: 36811 - DNA, 396 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactctcaggggaagccgaagtttccaaaaggtcgttgatcaaagctcgccgcgttgtttcatcggagacctcaagaaagcaatcccacctcactgcttcaaacgctccatcccacgctccttctcctcttcgacatcatcatctcctcctcggctcctccctctaccacctctccacagcctacttccctctcccttacctcgcctgaccactctactgggcctgccaaggctgcgtcctaacgggcctctgggtcatcgcccacgaatgcggccaccacgccttcagcgactac

SEQ ID NO: 36812 - DNA, 371 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaacccccaaacgcgtcccctgcgagacaccacccttcactctcgccggtgctgtgccaggcccagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36813 - DNA, 353 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacacctccattcactctggagacctcaagaaaccaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 36814 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcagacctcaagaaagcaatcccacctcactgcttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 36815 - DNA, 383 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagcaggtggtggccatcgccagccacgatggcggcaagcaggcgctggagaactcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36816 - DNA, 337 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgagaactcaagaaagcaatcccaccgcactgtttcaaacgctcgatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36817 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcctcgtctcctcctccctctaccacctctccacagcctacttccctctcccttacctcgcctggcctctctactgggcctgccagggctgcgtcctaaccggcgtctgggtcatagcccacgagtgcggccaccacgccttcagcgactac

SEQ ID NO: 36818 - DNA, 396 bp, Artificial
  Mutation in BnaC.FAD2.b introduced by TALE nuclease pair BnFAD2_T03
caggatccatgggttcaggcggaagaatgcaagtctctcctccctccagctcccccgaaaccaaaaccctcaaacgcgtcccctgcgagacaccacccttcactctcaggggaagccgaagtttccaaaaggtcgttgatcaaagctcgccgcgttgtttcatcggagacctcaagaaagcaatcccacctcactgcttcaaccgctccatctcacgctccttctcctcttcgacatcatcatctcctcctcggctcctccctctcccacctctccacagcctacttccctctcccttacctcgcctgccccctctacggggcctgccaagcatgcgtcctaacgggcctctgggtcatagcccacgagtgcggccaccacgccttcagcgactac

SEQ ID NO: 36819 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 36820 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaattccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36821 - DNA, 279 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36822 - DNA, 389 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtctccagcggctgttgccgccatcgtggctggcgatggccaccacctgctccggagaactcaagaaagcaatcccaccgcactgtttcaaacgctcgatccctcgctccttctcctacctcctcttcgacatcctcgtctcctcctccctctaccacctctccacagcctacttccctctcccttccctcgcctgacccctctactgggcctgccaaggctgcgtcctaacgggcctctgggtcatagcccacgagtgcggccaccacgcctttcagcgactac

SEQ ID NO: 36823 - DNA, 333 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36824 - DNA, 468 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggtggccatcgccagcaataatggtggcaagcaggcgctggagccggtccagcggctgttgccggcgctgtgccaggcccacggcttgaccccccagccggcggtggccaccgccagagacctcaagaaagcaatcccacctcactgcttcaaacgctccatccctcgctccttctcctacctcctctgcgacatcctcgtctcctcctccctctaccacctcgccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36825 - DNA, 335 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36826 - DNA, 381 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggccttctgcttagtttgatgcctggcagtttatggcgggcataagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36827 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatccctcgctccttttcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36828 - DNA, 335 bp, Artificial
  Mutation in BnaC.FAD2.b introduced by TALE nuclease pair BnFAD2_T03
caggatccatgggtgcaggtggaagaatgcaagtctctcctccctccagctccccccgaaccaacaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36829 - DNA, 274 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36830 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 36831 - DNA, 349 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36832 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgaatgcggccaccacgccttcagcgactac

SEQ ID NO: 36833 - DNA, 328 bp, Artificial
  Mutation in BnaC.FAD2.b introduced by TALE nuclease pair BnFAD2_T03
caggatccatgggtggaggtggaagaatgcaagtctctcctccctccagctcccccggaaccaacaccctcaaacgcgtcccctgcgagacaccaccattcactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36834 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 36835 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacacctcaagaaagcaatcccacctcactccttcaaacgccccatcccaccctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 36836 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 36837 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36838 - DNA, 279 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 36839 - DNA, 354 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36840 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 36841 - DNA, 350 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcccgccaaggctgcgtcctaacgggcctctgggtcatcgcccacgaatgcggccaccacgccttcagcgactac

SEQ ID NO: 36842 - DNA, 376 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggtggccatcgccagcaatggcggtggcaacagccgctggagacctcaagaaagcaatcccacctcactgcttcaaacgctccatcccacgctccttctcctcttcgacatcatcatctcctcctcggctcctccctctaccacctctccacagcctacttccctctcccttaccacgcctgacccctctactgggcctgccaaggctgcgtcctaacgggcctctgggtcatagcccacgagtgcggccaccacgccttcagcgactac

SEQ ID NO: 36843 - DNA, 340 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacccttcacagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36844 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgagaactcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 36845 - DNA, 336 bp, Artificial
  Mutation in BnaC.FAD2.b introduced by TALE nuclease pair BnFAD2_T03
caggatccatgggtgcaggtggaagaatgcaagtctctcctccctccagctccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36846 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccatttcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36847 - DNA, 441 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgcccagtcggcagcggcatccttcggcgcgattttgccggttactgcgctgtaccaaatgcgggacaacgtaagcactacatttcgctcatagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 36848 - DNA, 337 bp, Artificial
  Mutation in BnaC.FAD2.b introduced by TALE nuclease pair BnFAD2_T03
caggatccatgggtgcaggtggaagaatgcaagtgtctcctcccttcagctcccccggaaccaacaccctcaaacgcgtcccctgcgagacaccaccattcacctggagacctcaagaaagcaatcccacctcactgcttcaaacgctccatcccacgctccttctcctcttcgacatcatcatctcctcctcggctcctccctctaccacctctccacagcctacttccctctctcctacttcgcctggcctctctactgggcctgccaagggtgcgtcctaacgggcctctgggtcatagcccgcgagtgcggccaccacgcctgcagcgactac

SEQ ID NO: 36849 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 36850 - DNA, 368 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccatgcgagacaccgcccttcactgtagcaatggcggtggctggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36851 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatatcccacgagtgcggccaccacgccttcagcgactac

SEQ ID NO: 36852 - DNA, 346 bp, Artificial
  Mutation in BnaC.FAD2.b introduced by TALE nuclease pair BnFAD2_T03
caggatccatgggtgcaggtggaagaatgcaagtctctcctccctccagctccgccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36853 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36854 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactggagacctcaagaaagcaatcccacctcactgcttcaaacgctccatccctcgctccttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36855 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccactccttcagcgactac

SEQ ID NO: 36856 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctagcaggcgctggagacctcaagaaagcaatcccacctcactgcttcaaacgctccatcccacgctccttctcctcttcgacatcatcatctcctcctcggctactccctctaccacctctccacagcctacttccctctcccttacctcgcctgacccctatactgggcctgccaaggctgcgtcctaacgggcctctgggtcatcgcccacgaatgcggccaccacgccttcagcgactac

SEQ ID NO: 36857 - DNA, 334 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcttcctgacgggcctctgggtcatagcccacgaatgcggccaccacgccttcagcgactac

SEQ ID NO: 36858 - DNA, 335 bp, Artificial
  Mutation in BnaC.FAD2.b introduced by TALE nuclease pair BnFAD2_T03
caggatctatgggtgcaggtggaagaatgcaagtctctcctccctccagctcccccggaaccaacaccctcaaacgcgtcccctgcgatacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36859 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccacctcactgcttcaaacgctccatcccacgctccttctcctcttcgacataatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36860 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaagacctcaagaaagcaatcccaccccactgcttcaaacgctccatccctcgctccttctcctacctcctcttcgacatcctcgtctcctcctccctctaccacctctccacagcctacttccctctcccttacctcgcctggcctcactactgggcctgccagggctgcgtcctaaccggcgtctgggtcatagcccacgagtgcggccaccacgccttcagcgactac

SEQ ID NO: 36861 - DNA, 457 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctatgagacaccaccattcactcatcatataatttctgttgaattacgttaagcatgtaataattgatggccagcaatattggtggcaagcaggcgctggagacggtgcaggcgctgttgccggtgctgtgccaggcccacggcttgacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36862 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36863 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctaccaaggctgcgtcctaacgggcctctgggtcatagcccacgagtgcggccaccacgccttcagcgactac

SEQ ID NO: 36864 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgcctgcagcgactac

SEQ ID NO: 36865 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 36866 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactctgagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36867 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccgaggctgcgtcctaacgggcctctgggtcatagcccacgagtgcggccaccacgccttcagcgactac

SEQ ID NO: 36868 - DNA, 416 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctctgggtggccatcgccagcaatggcggtggcaagcaggcgctggagacggtccagcggctgttgcccgtgcggaggcctccagaaagcaatcccacctcactgcttcaaacgctccatccctccccccttctcctacctcctcttcgacatcaccctctcctcctcggctcctccccctcccacctccccacagcctccttccctctcccttacctcgcctgacccctctactgggcctgccagggctgcgtcctaaccggcgtctgggtcatagcccacgagtgcggccaccacgccttcagcgactac

SEQ ID NO: 36869 - DNA, 349 bp, Artificial
  Mutation in BnaC.FAD2.b introduced by TALE nuclease pair BnFAD2_T03
caggatccatgggtgcaggtgcaagaatgcaagtctctcctcactccagctcccccgaaaccaaaaccctcaaacgcgtcccctgcgagacaccacccttcactcagaccacaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36870 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccacggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 36871 - DNA, 313 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctcaccctctctcctacttcgcctggcctctctactgggcctgccagggctgcgtcctaaccggcctctgggtcatagcccacgagtgcggccaccacgccttaagcgactac

SEQ ID NO: 36872 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcctttttacggttcctctccctcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36873 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacaagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36874 - DNA, 396 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctacaggcccacggcttgaccccccagcaggtggtggccatcgccagcaataatggtggcggagacctcaagaaagcaatcccacctcactgcttcaaacgctccatcccacgctccttctcctcttcgacatcatcatctcctcctcggctcctcccgcttccacctccccacagcctacttccctctcccttgcctcgcctggcccctctactgggcctgccaaggctgcgtcctaacgggcctctgggtcatagcccacgagtgcggccaccacgccttcagcgactac

SEQ ID NO: 36875 - DNA, 350 bp, Artificial
  Mutation in BnaC.FAD2.b introduced by TALE nuclease pair BnFAD2_T03
caggatccatgtgtgcaggtggaagaatgcaagtctctactccctccagctcccccggaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36876 - DNA, 346 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36877 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccagggctgcgtcctaaccggcgtctgggtcatagcccacgagtgcggccaccacgccttcagcgactac

SEQ ID NO: 36878 - DNA, 346 bp, Artificial
  Mutation in BnaC.FAD2.b introduced by TALE nuclease pair BnFAD2_T03
caggatccatgggttcaggtggcagaatgcaagtctctcctccctccagctcccccgaaaccaaaaccctcaaacgcgtcccctgcgagacaccacccttcacgacctcaagaaagcaatcccacctcactgcttcaaacgctccatccctcgctccttctcctacctcctcttcgacatcctcgtctcctcctccctctaccacctctccacagcctacttccctctcctcccccaccctcgcccttgcctcgcctggcccctctacggggcctgccaaggctgcgtccgaacgggcctctgggtcatctcccacgaatgcggccaccacgccttcagcgactac

SEQ ID NO: 36879 - DNA, 331 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgaaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36880 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36881 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 36882 - DNA, 294 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 36883 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactagacctcaagaaagcaatcccacctcactgcttcaaacgctccatccctcgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 36884 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacttagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36885 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36886 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccgacaccatcaagcgcgtaccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36887 - DNA, 330 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgtagacctcaagaaagcaatcccacctcactgcttcaaacgctccatccctcgccccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36888 - DNA, 338 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtggagaactcaagaaagcaatcccacctcactgcttcaaacgctccatcccacgctccttctcctcttcgacatcatcatctcctcctcggctcctccctctaccacctctccacagcctacttccctctcccttacctcgactgacccctctactgggcctgccaaggctgcgtcctaacgggcctctgggtcatagcccacgagtgcggccaccacgccttcagcgactac

SEQ ID NO: 36889 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 36890 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 36891 - DNA, 434 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcagcgcctgcttgccgccatcgtggctggcgatggccaccacctgctccggggtcaagccgtgggcctggcacagcaccggcaacagccgctggacggagacctcaagaaagcaatcccacctcactgcttcaaacgctccatcccacgctccttctcctcttcgacatcatcatctcctcctcggctcctccctctaccacctccccacagcctacttccctctcccttacctcgcctgacccctctactgggcctgccaaggctgcgtcctaacgggcctctgggtcatagcccacgagtgcggccaccacgccttcagcgactac

SEQ ID NO: 36892 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccccagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36893 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatctcccacgaatgcggccaccacgccttcagcgactac

SEQ ID NO: 36894 - DNA, 418 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatccactctgcgagacaccaccatgcaagtctctcctccctccagctcccccggaaccaacaccctcaaacgcgtcccctgcgaggccccaccacctcaagaaagcaatcccacctcactgcttcaaacgctccatcccacgctccttctcctcttctccatcatcacctcctccccggcccctccctctaccacctctccacaccctacttccctctcccttacctcccctgacccctctactgggcctgccaaggctgcgtcctaacgggcctctgggtcatcgcccacgaatgcggccaccacgccttcagcgactac

SEQ ID NO: 36895 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacttcctcttcgccatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 36896 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 36897 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaacgggcctctgggtcatcgcccacgaatgcggccaccacgccttcagcgactac

SEQ ID NO: 36898 - DNA, 317 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgggagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatctcccacgaatgcggccaccacgccttcagcgactac

SEQ ID NO: 36899 - DNA, 463 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacaccacctgctccggggtcaagccgtgggcctggcacagcaccggcaacagcgcctgcaccgtctccagcgcctgcttgccaccaatattgctggcgatggccaccacctgctccggagacctcaagaaagcaatcccacctcactgcttcaaacgctccatccctcgctccttcccctaccccctctccgacatcctcgtctcctcccccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36900 - DNA, 396 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacaccaccattcagcggatttgtcctactcaggagagcgttcaccgacaaacaacagataaaacgaaaggcccagtcttccctcaagaaagcaatcccaccgcactgcttcaaacgctccatcccacgctccttctcctcttcgacatcatcatctcctcctcggctcctccctctaccacctctccacagcctccttccctctcccttacctcgcctgacccctctactgggcctgccaaggctgcgtcctaacgggcctctgggtcatatcccaccagtgcggccaccacgccttcagcgactac

SEQ ID NO: 36901 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 36902 - DNA, 317 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36903 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactaaagcaatcctacctcacttcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36904 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactcc

SEQ ID NO: 36905 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36906 - DNA, 349 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 36907 - DNA, 409 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggctgcggcgagcggtatcagctcactcaaaggcggtaatacggttatccacagaatcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36908 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaaccttcactcacctcaagaaagcaatcccacctcactgcttcaaacactccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36909 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcacttagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36910 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36911 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggcggcgtcctaacgggcctctgggtcatcgcccacgaatgcggccaccacgccctcagcgactac

SEQ ID NO: 36912 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36913 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccatgacagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 36914 - DNA, 369 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttccccggagcaggtggtggccatcgccagcaatattggtggagacctcaagaaagcaatcccacctcactgcttcaaacgctccatccctcgctccttctcctacctcctcttcgacatcctcgtctcctcctccctctaccacctctccacagcctccttccctctcccttacctagcctgacccctctactgggcctgccaaggctgcgtcctaacgggcctctgggtcatagcccacgagtgcggccaccacgccttcagcgactac

SEQ ID NO: 36915 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggagacctcaagaaagcaatcccacctcactgcttcaaacgctccatcccacgctccttctcctcttcgacatcatcatctcctcctcggctcctccctcaccctctctcctacttcgcctggcctctctactgggcctgccaagggtgcgtcctaaccggcgtctgggtcatagcccacgagtgcggccaccacgccttcagcgactac

SEQ ID NO: 36916 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatctcccacgaatgcggccaccacgccttcagcgactac

SEQ ID NO: 36917 - DNA, 306 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 36918 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactcaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36919 - DNA, 347 bp, Artificial
  Mutation in BnaC.FAD2.b introduced by TALE nuclease pair BnFAD2_T03
caggatccatgggtgcaggtggaagaatgcaagtctctcctccctccagctccaccgaaaccaaaaccctcaaacgcgtcccctgcgagacaccacccttcactctcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36920 - DNA, 321 bp, Artificial
  Mutation in BnaC.FAD2.b introduced by TALE nuclease pair BnFAD2_T03
caggatccatgggtgcaggtggaagaatgcaagtccctcctccctccagctccaccggacccaacaccctcaaacgcgtcccctgcgagcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccatcagcgactac

SEQ ID NO: 36921 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccctggcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 36922 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 36923 - DNA, 278 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgacta

SEQ ID NO: 36924 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggccccgctactgggcctgccaaggctgcgtcctaacgggcctctgggtcatcgcccacgaatgcggccaccacgccttcagcgactac

SEQ ID NO: 36925 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 36926 - DNA, 335 bp, Artificial
  Mutation in BnaC.FAD2.b introduced by TALE nuclease pair BnFAD2_T03
caggatccatgggtgcggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36927 - DNA, 352 bp, Artificial
  Mutation in BnaC.FAD2.b introduced by TALE nuclease pair BnFAD2_T03
caggatccatgggtgcaggtggcagaatgcaagtctctactccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaagggtgcgtcctaacgggcctctgggtcatcgccctcgaatgcggccaccacgccttcagcgactac

SEQ ID NO: 36928 - DNA, 379 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccagaacgggtagtgaattgcgcttgagatggtttaatttcaactttaatcattattgaattccctcgggtttcccacctcactgcttcaaacgctccatccctcgctccttctcctacctcctcttcgacatcctcgtctcctcctccctctaccacctctccacagccttccaccctctcccttacctcgcctgaccccgctcctgggcccgccaaggctgcgtcctaacgcgcctctgggtcatagcccacgagtgcggccaccacgccatcagcgactac

SEQ ID NO: 36929 - DNA, 348 bp, Artificial
  Mutation in BnaC.FAD2.b introduced by TALE nuclease pair BnFAD2_T03
caggatccatgggtgcaggtggaagaatgcaagtctctcgtccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcccacttccctctcctccccaaccctctcccttgcctcccccggcccctctactgggcctgccaaggctgcgtcctaacgctcctctgggtcatcgcccacgactgcggccaccacgccttcagcaactac

SEQ ID NO: 36930 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36931 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcgcctcctccctctaccacctctccacagcctacttccctctcccttacctcgccttacccctctactgggcctgccaagggtgcgtcctaaccggcgtctgggtcatagcccacgagtgcggccaccacgccttcagcgactac

SEQ ID NO: 36932 - DNA, 336 bp, Artificial
  Mutation in BnaC.FAD2.b introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36933 - DNA, 279 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttcgacatcctcgtctcctcctccctctaccacctctccacagcctacttccctctcctcccccaccctctcccttacctcacctggcccctctactgggcctgccaaggctgcgtcctaacgggcctctgggtcatcgcccacgaatgcggccaccacgccttcagcgactac

SEQ ID NO: 36934 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaagcgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36935 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36936 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36937 - DNA, 356 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgttcggctgcggcgagcgcagacctcaagaaagcaatcccaccccactcctccaaactctccatcccaccctccttctcctcttcgacatcatcatctcctcctcggctcctccctctcccacctctctacagcctccttccctctcccttacctcgcctgacccctctactgggcctgccaaggctgcgtcctaacgggcctctgggtcatagcccacgagtgcggccaccacgccttcagcgactac

SEQ ID NO: 36938 - DNA, 319 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36939 - DNA, 400 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcaccggcaacagccgctggaccgtctccagcgcctgcttgccaccagagacctcaagaaagcaatcccacctcactgcttcaaacgctccatccctcgctccttctcctacctcctcttcgacatcctcgtctcctcctccctctaccacccctccacagcctacttccctctcctccccccccctctcccttacctcgcctggcccctctactgggcctgccaaggctgcgtcctaacgggcctctgggtcatagcccacgagtgcggccaccacgccttcagcgactac

SEQ ID NO: 36940 - DNA, 344 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccatggcggacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36941 - DNA, 327 bp, Artificial
  Mutation in BnaC.FAD2.b introduced by TALE nuclease pair BnFAD2_T03
caggatcctgggtgcaggtggaagaatgcaagtctctcctccctctagctcccccggaaccaacaccctcaaacgcgtcccctgcgagacaccaccattcactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggcgcgtcctaaccggcgtctgggtcatatcccacgagtgcggccaccacgccttcagcgactac

SEQ ID NO: 36942 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 36943 - DNA, 354 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgggagaactcaagaaagcaatcccacctcactgcttcaaacgctccatccctcgctccttctcctacctcctcttcgacatcctcgtctcctcctccctctaccacctctccacagcctacttccctctcctcccccaccatctcccttacctcgcctggcccctctactgggcctgccaaggctgcgtcctaacgggcctctgggtcatcgcccacgaatgcggccaccacgccttcagcgactac

SEQ ID NO: 36944 - DNA, 350 bp, Artificial
  Mutation in BnaC.FAD2.b introduced by TALE nuclease pair BnFAD2_T03
caggatccatgggtgcaggtggatgaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcggactac

SEQ ID NO: 36945 - DNA, 408 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccgcccttcactgtcggcaagcaggcgctggagacggtccagcggctgttgccggtgctgtgccaggcccacggcttgaccacggcagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgagcctgccaaggctgcgtcctaacgggcctctgggtcatcgcccacgaatgcggccaccacgccttcagcgactac

SEQ ID NO: 36946 - DNA, 350 bp, Artificial
  Mutation in BnaC.FAD2.b introduced by TALE nuclease pair BnFAD2_T03
caggatccatgggtgcaggtggaagaatgcaagtctctcctacctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36947 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactaagacctcaagaaagcaatcccacctcactgcttcaaacgctccatcccacgccccttctcctcttcgacctcatcatctcctcctcggctcctccctctaccacccctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 36948 - DNA, 348 bp, Artificial
  Mutation in BnaC.FAD2.b introduced by TALE nuclease pair BnFAD2_T03
caggatccatgggtgcaggtggaagaatgcaagtctctcctccatccagctcccccggaaccaaaaccctcaaacgcgtcccctgcgagacaccacccttcactcgacctcaagaaagcaatcccacctcacggcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36949 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatccctcgctccttctcctacctcctcttcgacatcctcgtctcctcctacctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 36950 - DNA, 329 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36951 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 36952 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactcagacctcaataaagcaatcccaccgcactgtttcaaacgctcgatccctcgctctttctcctcttcgacatcatcatctcctcctcggctcctccctctaccacctctccacagcctacttccctctcccttacctcacctgacccctctactgggcctgccaaggctgcgtcctaacgggcctctgggtcatcgcccacgaatgcggccaccacgccttcagcgactac

SEQ ID NO: 36953 - DNA, 322 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 36954 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36955 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccatgcgagacaccacccttcactctagaccgcaagaaagcaatcccaccacactgcttcaaacactccatccctcgctccttctcctacctcctcttcgacatcctcttctcctcctccctctaccacgtctccacagcctacttccctctcctcccccaccctctcccttacctcgcctggcccctctactgggcctgccagggctgcgtcctaacgggcctctgggtcatcgcccacgaatgcggccaccacgccttcagcgactac

SEQ ID NO: 36956 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36957 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 36958 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcctgcagcgactac

SEQ ID NO: 36959 - DNA, 336 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 36960 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctccgccggagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36961 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36962 - DNA, 402 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgccccctggcttgaccccggagcaggtggtggccatcgccagccacgatggcggcaacagccgctggaccgagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 36963 - DNA, 431 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactctcggctgttgccggtgctgtgccaggcccacggcttgaccccccagcaggtggtggccatcgccagcaatggcggtggcaagcaggcgctggagacggacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 36964 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattctcaagaaagcaatcccacctcactgcttcaaacgctccatcccacgctccttctcctcttcgacatcatcatctcctcctcggctcctccctctaccacctctccacagcctacttccctctcccttacttcgcctggcctctctactgggcctgccaaggctgcgtcctaacgggcctctgggtcatagcccacgagtgcggccaccacgccttcagcgactac

SEQ ID NO: 36965 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctacaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36966 - DNA, 333 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36967 - DNA, 424 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcgggggaaacgcctggtatctttatagtcctgtcgggtttcgccacctctgacttgagcgtcgatttttgtgatgctcgtcaggggggcagacctcaagaaagcaatcccacctcactgcttcaaacgctccatccctcgctccttctcctacctcctcttcgacatcctcgtctcctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36968 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctgacgggcctctgggtcatcgcccacgaatgcggccaccacgccttcagcgactac

SEQ ID NO: 36969 - DNA, 334 bp, Artificial
  Mutation in BnaC.FAD2.b introduced by TALE nuclease pair BnFAD2_T03
caggatccatgggtgcagtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctccctcacctcgcctgacccctctactgggccggccaaggctgcgtcctaacgggcctctgggtcatagcccacgagtgcggccaccacgccttcagcgactac

SEQ ID NO: 36970 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctcaagaaagcaatcccacctcactgcttcaaacgctccatcccacgctccttctcctcttcgacatcctcgtctcctcctccctctaccacctatccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36971 - DNA, 327 bp, Artificial
  Mutation in BnaC.FAD2.b introduced by TALE nuclease pair BnFAD2_T03
caggatccatgggtgcaggtgcaagaatgcaagtctctcctccatccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36972 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacttggcctgccaaggctgcgtcctaacgggcctctgggtcatcgcccacgaatgcggccaccacgccttcagcgactac

SEQ ID NO: 36973 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36974 - DNA, 400 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcccacggcttgaccccccagcaggtggtggccatcgccagcaatggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36975 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 36976 - DNA, 266 bp, Artificial
  Mutation in BnaC.FAD2.b introduced by TALE nuclease pair BnFAD2_T03
caggatccatgggtgcaggtggaagaatgcaagtctcgacctcaagaaagcaatcccacctcactgcttcaaacgctccatcccacgctccttctcctcttcgacatcatcatctcctcctctgctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 36977 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36978 - DNA, 328 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36979 - DNA, 357 bp, Artificial
  Mutation in BnaC.FAD2.b introduced by TALE nuclease pair BnFAD2_T03
caggatccatgggtgcaggtggaataatgcaagtctctcctccctccagctcccccgaaaccaaaaccctcaaacgcgtcccctgcgagacaccacccttcactctcggcctttttacggttcctctccctcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36980 - DNA, 279 bp, Artificial
  Mutation in BnaC.FAD2.b introduced by TALE nuclease pair BnFAD2_T03
caggatccatgggtgcaggtggaagaatgcaagtctctcctccctccagcaatcccacctcactgcttcaaacgctccatccctcgctccttcccctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 36981 - DNA, 432 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggctgttgccggtgctgtgccaggcccacggcttgaccccggagcaggtggtggccatcgccagccacgatggcggcaagagacctcaagaaagcaatcccaccccactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36982 - DNA, 423 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgactacggcgtgatcgtggacaccacgagcatcacaaaaatcgacgctcaagtcagaggtggcgaaacccggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 36983 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 36984 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36985 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactctcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 36986 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgcttcaaacgctccatcccacgctccttctcctcttcgacatcatcatctcctcctcggctcctccctctaccacctatccacagcctacttccctctcccttacctcgcctgacccctctactgggcctgccaaggctgcgtcctaacgggcctctgggtcatagcccacgagtgcggccaccacgccttcagcgactac

SEQ ID NO: 36987 - DNA, 349 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactcagacctcaagaaagcaatcccaccgcactgtttcaaacgctcgatccctcgctctttctcctacctcatctgggacatcatcatagcctcctgcttctactacgtcgccaccacttacttccctctcctcccccaccctcgcccttacctcgcctggcccctctactgggcctgccaaggctgcgtcctaacgggcctctgggtcatagcccacgagtgcggccaccacgccttcagcgactac

SEQ ID NO: 36988 - DNA, 394 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccagaacgggtagtgaattgcgcttgagatggtttaatttcaactttaatcattattgaattccctcgggtttcccacctcactgcttcaaacgctccatccctcgctccttctcctacctcctcttcgacatcctcgtctcctcctccctctaccacctctccacagcctacttccctctcctccccccccctctcccttacctcgcctggcccctctactgggcctgccaaggctgcgtcctaacgggcctctgggtcatcgcccacgaatgcggccaccacgccttcagcgactac

SEQ ID NO: 36989 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36990 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatcgcccacgaatgcggccaccacgccttcagcgactac

SEQ ID NO: 36991 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccatggctgcgtcctaacgggcctctgggtcatagcccacgagtgcggccaccacgccttcagcgactac

SEQ ID NO: 36992 - DNA, 363 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgcggcgggggtgggggttacgcgcaaagacctcaagaaagcaatcccccctcactgcttcaaacgctccatcccccgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36993 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 36994 - DNA, 349 bp, Artificial
  Mutation in BnaC.FAD2.b introduced by TALE nuclease pair BnFAD2_T03
caggatccatgggtgcaggtggaagaatgcaagtatttactcccttcagctcctccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctccctcaccctctctccttcttcgcctggcccctctactaggcctgccaaggctgcgtcctaacgggcctctgcgtcatcgcccacgaatgcggccaccacgccttcagcgactac

SEQ ID NO: 36995 - DNA, 389 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagtcctgtcgggtttcgccacctctgacttgagcgtcgatttttgtgatgctcggagacctcaagaaagcaatcccacctcactgcttcaaacgctccatcccacgctccttctcctcttcgacatcatcatctcctcctcggctcctccccctaccacctctccacggcctacttccctctcccttacctcgcctgacccctctactgggcctgccaaggctgcgtcctaacgggcctctgggtcatagcccacgagtgcggccaccacgccttcagcgactac

SEQ ID NO: 36996 - DNA, 401 bp, Artificial
  Mutation in BnaC.FAD2.b introduced by TALE nuclease pair BnFAD2_T03
caggatccatgggtgcaggtggaagaatgcaagtgcctcctccctccaagaagtctgaaaccgacaccatcaagcgcgtaccctgcgagacaccgcccttcacggtccagcggctgttgccgccatcgtggctggcgatggccaccacctgctccggagaactcaagaaagcaatcccacctcactgcttcaaacgctccatccctcgctccttctcctacctcctcttcgacatcctcgtctcctcctccctctaccccctctccacagcctacttccccctcctcccccaccctctcccttacctcgcctggcccctctactgggcctgccaagggtgcgtcctaaccggcgtctgggtcatagcccacgagtgcggccaccacgccttcagcgactac

SEQ ID NO: 36997 - DNA, 265 bp, Artificial
  Mutation in BnaC.FAD2.b introduced by TALE nuclease pair BnFAD2_T03
caggatccatgggtgcaggtggaagaatgcaagtctctcctccctccagtctctccacctcactgcttcaaacgctccatcccacgctccttctcctcttcgacgtcatcatctcctcctcggctcctccccctaccacttctccacagcctacttccctctcccttacctcgcctgacccctctactgggcctgccaaggctgcgtcctaacgggcctctgggtcatagcccacgagtgcggccaccacgccttcagcgactac

SEQ ID NO: 36998 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 36999 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacctcaagaaagcaatcccacctcactgcttcaaacgctccatccctcgctccttctcctacctcctcttcgacatcctcgtctcctcctcggctcctccccctaccacctctccacagcctacttccctctcccttacctcgcctggcccctctactgggcctgccaaggctgcgtcctaacgggcctctgggtcatcgcccacgagtgcggccaccacgccttcagcgactac

SEQ ID NO: 37000 - DNA, 397 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcagccgaacgaccgagcgcagcgagtcagtgagcgaggaagcggaagagcgcccaatacgcggagacctcaagaaagcaatcccacctcactgcttcaaacgctccatcccacgctccttctcctcttcgacatcatcatctcctcctcggctcctccctctaccacctctccacagcctacttccctctcccttccctcgcctgacccctctactgggcctgccaaggctgcgtcctaacgggcctctgggtcatagcccacgagtgcggccaccacgccttcagcgactac

SEQ ID NO: 37001 - DNA, 302 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37002 - DNA, 306 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 37003 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccttgcgagacaccacccttcactccctcaagaaagcaatcccacctcactgcttcaaacgctccatccctcgctccttctcctacctcctcttcgacatcctcgtctcctcctccctctaccacctctccacagccttcttccctctcctcccccaccctctcccttacctcccctggcccctctactgggcctgccaaggctgcgtcctaacgggcctctgggtcatcgcccacgaatgcggccaccacgccctcagcgactac

SEQ ID NO: 37004 - DNA, 347 bp, Artificial
  Mutation in BnaC.FAD2.b introduced by TALE nuclease pair BnFAD2_T03
caggatccatgggtgcaggaggaagaatgcaagtctctcctccctccagctcccccggaaccaacaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37005 - DNA, 382 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactactgacagaaccgcaacgttgaaggagccactcagccgcgggtttctgagacctcaagaaagcaatcccacctcactgcttcaaacgctccatcccacgctccttctcctcttcgacatcatcatctcctcctcggctcctccctctaccccctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37006 - DNA, 396 bp, Artificial
  Mutation in BnaC.FAD2.b introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtacggatggccttctgcttagtttgatgcctggcagtttatggcgggcatactcaagaaagcaatcccacctcactgcttccaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37007 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcttacttccctctcccttacctcgcctgacccctctactgggcctgccaaggctgcgtcctaactggcctctgggtcatagcccacgagtgcggccaccacgccttcagcgactac

SEQ ID NO: 37008 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgaccccgctactgggccagccaaggctgcgtcctaacgggcctctgggtcatcgcccacgaatgcggccaccactccttcagcgactac

SEQ ID NO: 37009 - DNA, 351 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37010 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37011 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 37012 - DNA, 343 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctagacctcaagaaagcaatcccacctcactgcttcaaacgctccatccctcactccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37013 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37014 - DNA, 378 bp, Artificial
  Mutation in BnaC.FAD2.b introduced by TALE nuclease pair BnFAD2_T03
caggatccatgggtgcaggtggcagaatgcaagtgtctcctccctccagctcccccggaaccaacaccctcaaacgcgtcccctgcgagacaccaccattcactctcgcctgcttgccaccgccattgctggctatggccaccacctttgacctcaagaaagcaatcccacctcactgcttcaaacgctccatcccacgctccttctcctcttcgacatcatcatctcctcctcggctcctccctctaccacctctccccagcctacttccctctcccttacctcgcctggtccctctactgggcctgccaaggctgcgtcctaacgggcctctgggtcatcgcccacgaatgcggccaccacgccttcagcgactac

SEQ ID NO: 37015 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccagggctgcgtcctaaccggcgtctgggtcatagcccacgagtgcggccaccacgccttcagcgactac

SEQ ID NO: 37016 - DNA, 335 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagacaccaccattcacttagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37017 - DNA, 345 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttgagacctcaagaaagcaatcccaccgcactgcttcaaacgctccatccctcgctccttctcctacctcccccgcgacatcctccacgcctcctccctctaccacctcgccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37018 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactacctcaagaaagcaatcccacctcactgcttcaaacgctccatcccacgctccttctcctcttcggcatcatcatctcctcctcggctcctccctctaccacctctccacagcctacttccctctcccttacctcgcctgacccctctactgggcctgccaaggctgcgtcctcacgggcctctgggtcatatcccacgagtgcggccaccacgccttcagcgactac

SEQ ID NO: 37019 - DNA, 376 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactctaggcgacgaggtggtcgttggtcaacgcggccaacgccgggagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37020 - DNA, 362 bp, Artificial
  Mutation in BnaC.FAD2.b introduced by TALE nuclease pair BnFAD2_T03
cagatccatgggtgcaggtggacgaatgcaagtctctcctccctccagctcccccggaaccaacaccctcaaacgcgtcccctgcgagacaccaccattcactctcgcggcgggtgtggtggttacgcgcaaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 37021 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 37022 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37023 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 37024 - DNA, 325 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctaaagcaatcccacctcactgcttcaaacgctccatccctcgctccttctcctacctcctcttcgacatcctcgtctcctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 37025 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccaacgcgtcccccgcgagacaccacccttcactcgacctcaagaaagcaatcccaccgcactgcttcaaacgctccatccctcgctccttctcctacctcctcttcgacatcctcttctcctcctccctctaccacctctccacagcctacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 37026 - DNA, 349 bp, Artificial
  Mutation in BnaC.FAD2.b introduced by TALE nuclease pair BnFAD2_T03
caggatccatgggtgcaggtggaagaatgcaagtctcttctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37027 - DNA, 356 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcggcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37028 - DNA, 333 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaatgcgtcccctgcgagacaccaccattcactctcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37029 - DNA, 346 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaacgcgtcccctgcgagacaccaccattcactctcaggcgctggagacctcaagaaagcaatcccacctccctgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatatcccacgagtgcggccaccacgccttcagcgactac

SEQ ID NO: 37030 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccgcctcactgcttcaaacgctccatcccacgctccttctcctacctcctcttcgacatcctcgtctcctcctccctctaccacctctccacagcctacttccctctcctcccccaccctctcccttacctcgcatggcccctctactgggcctgccaaggctgcgtcctaacgggcctctgggtcatcgcccacgaatgcggccaccacgccttcagcgactac

SEQ ID NO: 37031 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcggctgggtcatagcccacgagtgcggccaccacgccttcagcgactac

SEQ ID NO: 37032 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcgacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37033 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 37034 - DNA, 343 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctagacctcaagaaagcaatcccacctcaatgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgaatgcggccaccacgccttcagcgactac

SEQ ID NO: 37035 - DNA, 345 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37036 - DNA, 349 bp, Artificial
  Mutation in BnaC.FAD2.b introduced by TALE nuclease pair BnFAD2_T03
caggatccatgggtgcaggtggaagaatgcaagtctctcctccctcccgctcccccgaaaccaaaaccctcaaacgcgtcccctgcgcgacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactggtcctgccaaggctgcgtcctaacgggcctctgtgtcatagcgcacgagtgcggccaccacgccttcatcgactac

SEQ ID NO: 37037 - DNA, 385 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgcaaatatttcttgtcaaaaatgctccactgacgttccataaattcccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 37038 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcacttagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 37039 - DNA, 349 bp, Artificial
  Mutation in BnaC.FAD2.b introduced by TALE nuclease pair BnFAD2_T03
caggatccatgggtgcaggtggaagaatgcaagtctctcctcccaccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37040 - DNA, 349 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggccgctgggtcatcgcccacgagtgcggccaccacgccttcagcgactac

SEQ ID NO: 37041 - DNA, 335 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 37042 - DNA, 305 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 37043 - DNA, 397 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattccggatggcctttttgcgtttctacaaactcttcctggctagcggtacgcgtattaattgcgttgcgagacctcaagaaagcaatcccacctcactgcttcaaacgctccatcccacgctccttctcctcttcgacatcatcatctcctcctcggctcctccctctaccacctctccacagcctccttccctctcccttacctcgcctgacccctctactgggcctgccaaggctgcgtcctaacgggcctctgggtcatagcccacgagtgcggccaccacgcctgcagcgactac

SEQ ID NO: 37044 - DNA, 349 bp, Artificial
  Mutation in BnaC.FAD2.b introduced by TALE nuclease pair BnFAD2_T03
cagtatccatgggtgcaggtggaagaatgcaagtgtctcctccctccaagaagtctgaaaccgacaccatcaagcgcgtaccctgcgagacaccgcccttcactgtaaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37045 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 37046 - DNA, 265 bp, Artificial
  Mutation in BnaC.FAD2.b introduced by TALE nuclease pair BnFAD2_T03
caggatccatgggtgcaggtggaagaatgcaagtctctcctccctccagtctctccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 37047 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaaggctgcgtcctaacgggcctctgggtcatcgcccacgaatgcggccaccacgccttcagcgactac

SEQ ID NO: 37048 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37049 - DNA, 354 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggagacctcaagaaagcaatcccacctcactgcttcaaacgctccatccctcgctccttctcctacctcctcttcgacatcctcgtctcctcctccctctaccacctctccacagcctacttccctcaccgcccccaccctctcccttacctcgcctggcccctctactgggcctgccagggctgcgtcctaaccggcgtctgggtcatagcccacgagtgcggccaccacgccttcagcgactac

SEQ ID NO: 37050 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacaccctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37051 - DNA, 335 bp, Artificial
  Mutation in BnaC.FAD2.b introduced by TALE nuclease pair BnFAD2_T03
cagatccatgggtgcaggtggaagaatgcaagtctctcctccctccagctcccccgaaaccaaaaccctcaaacgcgtcccctgcgagacaccaccattcacatgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37052 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaaccggcgtctgggtcatagcccacgagtgcggccaccacgccttcagcccctac

SEQ ID NO: 37053 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgccccatcccacgctccttctcctcttcgacatcatcatctcctcctcggctcctccctctaccacctctccacagcctacttccctctcccttacctcgcctgacccctctacggggcctgccaaggctgcgtcctaacgcgcctctgggtcatcgcccacgaatgcggccaccacgccatcagcgactgc

SEQ ID NO: 37054 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctaactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37055 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37056 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatcccacgctccttctcctcttcgacatcatcatctcctcctcggatcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37057 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37058 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37059 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 37060 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 37061 - DNA, 413 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattccgctggaccgtctccagcgcctgcttgccaccgccattgctggcgatggccaccacctgctggggggtcaagccgtgggcctagacctcaagaaagcaatcccacctcactgcttcaaacgctccatcccacgctccttctcctcttcgacatcatcatctcctcctcggctcctccctctcccacctctccacagcctacttccctctcccttccctcgcctgacccctctactgggcctgccaaggctgcgtcctaacgggcctctgggtcatagcccacgagtgcggccaccacgccttcagcgactac

SEQ ID NO: 37062 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37063 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactctagacctcaagaaagcaatcccacctcactgcttcaaacgctccatcccaccctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37064 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37065 - DNA, 345 bp, Artificial
  Mutation in BnaC.FAD2.b introduced by TALE nuclease pair BnFAD2_T03
caggatccatgggtgcaggtggaagaatgcaagtgtcccctccctccaagaagtctgaaaccgacaccatcaagcgcgtaccctgcgagacaccgcccttcactctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37066 - DNA, 318 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37067 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccatcagcgactac

SEQ ID NO: 37068 - DNA, 330 bp, Artificial
  Mutation in BnaC.FAD2.b introduced by TALE nuclease pair BnFAD2_T03
caggatccatggggcaggtggaagaatgcaagtctctcctccctccagctcccccggaaccaacaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37069 - DNA, 336 bp, Artificial
  Mutation in BnaC.FAD2.b introduced by TALE nuclease pair BnFAD2_T03
caggatccatgggtgcaggtggcagaatgcaagtgtctcctccctccaaaaagtctgaaaccgacaacatcaagcgcgtaccctgcgagacaccaccattcacctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37070 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37071 - DNA, 421 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactatttgatgcctggcagttccctactctcgccagcaataatggtggcaagcaggcgctggatacggtccagcggagaactcaagaaagcaatcccaccgcactgtttcaaacgctcgatccctcgctctttctcctacctcatctgggacatcatcatcgcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37072 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgtccacgaatgcggccaccacgccttcagcgactac

SEQ ID NO: 37073 - DNA, 313 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctcaccctctctcctacttcgcctgacccctctactgggcctgccaaggctgcgtcctaacgggcctctgggtcatagcccacgagtgcggccaccacgccttcagcgactac

SEQ ID NO: 37074 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcggagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 37075 - DNA, 353 bp, Artificial
  Mutation in BnaC.FAD2.b introduced by TALE nuclease pair BnFAD2_T03
caggatccatgggtgcaggtggaagaatgcaagtctcaactccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcgtctcctcctccctctaccacctctccacagcctacttccctctcctcccccaccctctcccttacctcgccgggcccctctactgggcctgccatggctgcgtcctaacgggcctctgggtcatagcccacgagtgcggccaccacgccttcagctactac

SEQ ID NO: 37076 - DNA, 379 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggggggtcaagccgtgggcctggcacagcaccggcaacagccgcagacctcaagaaagcaatcccacctcactgcttcaaacgctccatcccacgctccttctcctcttcgacatcatcatctcctcctcggctcctccctctaccccctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37077 - DNA, 357 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggtctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37078 - DNA, 305 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgcttcaaactctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37079 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37080 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaaacgcgtcccctgcgagacaccaccattcactctagacctcaagaaagcaatcccacctcactgcttcaaccgctccatccctccctccttctcctacctcctcttcgacatcctcgtctcctcctcgtctcctccctctcccacctctccacagcctacttccctcaccctctctcctacttcgcctggcctctctactgggcctgccagggctgcgtcctaaccggcgtctgggtcatagcccacgagtgcggccaccacgccttcagcgactac

SEQ ID NO: 37081 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctccatccctcgctccttctcctacctcctcttcgacatcctcgtctactcctccctctaccacctctccacagcctacttccctctcctcccccaccctctcccttacctcgcctgacccctctactgggcctgccaaggctgcgtcctaacgggcctctgggtcatcgcccacgaatgcggccaccacgccttcagcgactac

SEQ ID NO: 37082 - DNA, 404 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccggtccagcggctgttgccgccatcgtggctggcgatggccaccacctgctccggggtcaagccgtgggcagacctcaagaaagcaatcccacctcactgcttcaaacgctccatccctcgctccttctcctacctcctcttcgacatcctcgtctcctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37083 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 37084 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37085 - DNA, 368 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaacaccatcaacatcgtggctggcgatggccaccacctgtgccaggcccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37086 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37087 - DNA, 325 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccgacctcaagaaagcaatcccacctcactgcttcaaacgctccatccctcgctccttctcctacctcctcttcgacatcctcgtctcctcctccctctaccacctctccacagcctacttccctctcccttacctcccctgacccctctactgggcctgccaaggctgcgtcctaacgggcctctgggtcatagcccacgagtgcggccaccacgccttcagcgactac

SEQ ID NO: 37088 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 37089 - DNA, 341 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccgaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37090 - DNA, 305 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgcttcaaacgctccatcccacgctccttctcctcttcgacatcatcatctcctcctcggctcctccctctaccacctctccacagcctacttccctctcccttacctcgcctgacccctctactgggcccgccaaggctgcgtcctaacgggcctctgggtcatcgcccacgaatgcggccaccacgccttcagcgactac

SEQ ID NO: 37091 - DNA, 415 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaacgcgtcccctgcgagacaccacccttcactctcgatgggcaggttgtagccgccggagtaggccttggtgtccacgatcacgccgtagtcgatggggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37092 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacttgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 37093 - DNA, 351 bp, Artificial
  Mutation in BnaC.FAD2.b introduced by TALE nuclease pair BnFAD2_T03
caggatccatgggtgcaggtggaagaatgcaagtatctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37094 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37095 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactaacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccaaggctgcgtcctaacgggcctctgggtcatcgcccacgaatgcggccaccacgccttcagcgactac

SEQ ID NO: 37096 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttgagaccccaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37097 - DNA, 396 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattgagcggatttgtcctactcaggagagcgctcaccgacaaacaacaaataaaacgaaatccccagtcttccctcaagaaagcaatcccacctcactgcttcaaacgctccatcccacgctccttctcctcttcgacatcatcatctcctcctcggctcctccccctcccacctccccaccgcctacttccctctcccttacctcgcctggcccctctactgggcctgccaaggctgcgtcctaacgggcctctgggtcatagcccacgagtgcggccaccacgccttcagcgactac

SEQ ID NO: 37098 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37099 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgcctgcagcgactac

SEQ ID NO: 37100 - DNA, 401 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttggccaccacctgctgaggggtcaagccgtgggcctggcacagcaccggcaacagccgctggaggagacctcaagaaagcaatcccacctcactgcttcaaacgctccatcccacgctccttctcctcttcgacatcatcatctcctccccggctcctccctctaccacctctccacagcctccttccctctcccttacctcgcctgacccctctactgggcctgccaaggctgcgtcctaacgggcctctgggtcatagcccacgagtgcggccaccactccttcagcgactac

SEQ ID NO: 37101 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcacgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37102 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctacggggcctgccaaggctgcgtcctaacgggcctctgggtcatagcccacgagtgcggccaccacgccttcagcgactac

SEQ ID NO: 37103 - DNA, 431 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggcaggtggtggccatcgccagcaatggcggtggcaagcaggcgctggagacggtccagcggctgttgccggtgctgggccaggcccacggctagacctcaagaaagcaatcccacctcactgcttcaaacgctccatcccacgctccttctcctcttcgacatcatcatctcctcctcggctcctccctctcccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 37104 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcctcaagaaagcaatcccacctcactgcttcaaacgctccatcccacgctccttctcctcttcgacatcatcatctcctcctcggctcctccctctatcacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37105 - DNA, 395 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggctgcggcgagcggtatcagctcactcaaaggcggtaatacggttatccacagaatcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37106 - DNA, 334 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcacttgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37107 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgcttcaaacgctccatcccacgctccttctcctcttcgacataatcatctcctcctcggctcctccctctaccacctctccacagcctacttccctctcccttacctcgcctgacccctctactgggcctgccaagggtgcgtcctaacgggcctctgggtcatcgcccacgaatgcggccaccacgccttcagcgactac

SEQ ID NO: 37108 - DNA, 349 bp, Artificial
  Mutation in BnaC.FAD2.b introduced by TALE nuclease pair BnFAD2_T03
caggatccatgggtgcaggtggaagaatgcaagtatctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37109 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgccccatcccacgctccttctcctacctcctcttcgacatcctcgtctcctcctccctctaccacctctccacagcctacttccctctcctcccccaccctctcccttgcctcgcctggcccctctactgggcctgccaaggctgcgtcctaacgggcctctgggtcatcgcccacgaatgcggccaccacgccttcagcgactac

SEQ ID NO: 37110 - DNA, 295 bp, Artificial
  Mutation in BnaC.FAD2.b introduced by TALE nuclease pair BnFAD2_T03
caggatccatgggtgcaggtggaagaatgcaagtatctcctccctccagctcccccgaaaccaaaaccctccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccatggctgcgtcctaacgggcctctgggtcatcgcccacgaatgcggccaccacgcctgcagcgactac

SEQ ID NO: 37111 - DNA, 315 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37112 - DNA, 316 bp, Artificial
  Mutation in BnaC.FAD2.b introduced by TALE nuclease pair BnFAD2_T03
caggatccatgggtgcaggtggaagaatgcaagtctctcctccctccaactcccccgaaaccaaaaccctcaaacgcgtaccctgcgagaccccaagaaatcattcccacctccccgcttcaaccgctccatccccctctccttctcctacctcctctccgccatcctcctctcctcccccctccaccacctctcccccgcctccttccctctcccttacctcgcctggcccctctactgggcctgccagggctgcgtcctaacgggcctctgggtcatcgcccacgaatgcggccaccacgccttcagcgactac

SEQ ID NO: 37113 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcacaagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37114 - DNA, 366 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgattataagttacttactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccacaacgccttcagcgactac

SEQ ID NO: 37115 - DNA, 376 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactctgctgcgtaacatcgttgctgctccagagacctcaagaaagcaatcccacctcactgcttcaaacgctccatccctcgctccttctcctacctcctcttcgacatcctcgtctcctcctccctctaccacctctccacagcctacttccctcgcctcccccaccctctcccttacctcgcctggcccctctactgggcctgccaaggctgcgtcctaacgggcctctgggtcatcgcccacgaatgcgtccaccacgccttcagcgactac

SEQ ID NO: 37116 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaacaaaaaccctcaaaggcgtcccttgcgggacaccacccttcactcgagacctcaagaaagcaatcccaccgcactttttcaaacgctcgatccctcgctctttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 37117 - DNA, 317 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcttggtcatagcccacgagtgcggccaccacgccttcagcgactac

SEQ ID NO: 37118 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37119 - DNA, 347 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37120 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacttcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37121 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctaactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37122 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggtcggagacctcaagaaagcaatcccacctcactgcttcaaacgctccatcccacgctccttctcctcttcgacatcatcatctcctcctcggctcctccctctaccacctctccacaccctacttccctctcccttacctcgcctggcccctctactgggcctgccaaggctgcgtcctaacgggcctctgggtcatcgcccacgaatgcggccaccacgccttcagcgactac

SEQ ID NO: 37123 - DNA, 441 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactcttgggctcccccatcgactacggcgtgatcgtggacaccaaggcctactccggcggctacgctatggaactcgccgcccgactgggctggcgagacctcaagaaagcaatcccacctcactgcttcaaacgctccatccctcgctccttctcctacctcctcttcggcatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37124 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagaccccacccttcactctcggcggagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37125 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37126 - DNA, 280 bp, Artificial
  Mutation in BnaC.FAD2.b introduced by TALE nuclease pair BnFAD2_T03
caggatccatgggtgcaggtggaagaatccaagtctcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37127 - DNA, 339 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37128 - DNA, 357 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactctccgccggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37129 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagacctcaagaaagcaatcccacctcactgcttcaaacgctccatcccacgctccttctcctcttcgacatcatcatctcctcctccctctaccacctctccacaacctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37130 - DNA, 347 bp, Artificial
  Mutation in BnaC.FAD2.b introduced by TALE nuclease pair BnFAD2_T03
caggatccatgggtgcaggtggaagaatgcaagtctcaactccctcaagctcccccgaaaccaaaaccctcaaacgcgtcccctgcgagacaccgcccttcactcacctcaagaaagcaatcccacctcactgcttcaaacgctccatccctcgctccttctcctacctcctcttcgacatcctcgtctcctcctccctctaccacctctccacagcctacttccctcgcctccccccccctctcccttacctcgcctggcccctctactgggcctgccaaggctgcggcctaacgggcctcggggtcatcgctcacgagtgcgtccaccacgccttgagcaactac

SEQ ID NO: 37131 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacacctacctcaagaaagcaatcccacctcactgcttcaaccgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37132 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37133 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgcctgcagcgactac

SEQ ID NO: 37134 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37135 - DNA, 296 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 37136 - DNA, 410 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacacggtccagcggctgttgccggtgctgtgccaggcccacggcttgacccctcagcaggtggtggccatcgccagcaatggcggcggcaggagacctcaagaaagcaatcccacctcactgcttcaaacgctccatcccacgctccttctcctacctcctcttcgacatcctcgtctcctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37137 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 37138 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctccatccctcactccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37139 - DNA, 387 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgtagcggtggtttttttgccggatcaagagctaccaactctttttccgaaggtaactggcttcagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 37140 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37141 - DNA, 323 bp, Artificial
  Mutation in BnaC.FAD2.b introduced by TALE nuclease pair BnFAD2_T03
caggatccatgggtgcaggtggcagaatgcaagtctctcctccctctagctcccccgaaaccaaaaccctcaaacgcgtcccctgcgagacaccacccttacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37142 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacacctacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 37143 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 37144 - DNA, 353 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgggaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgctac

SEQ ID NO: 37145 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 37146 - DNA, 369 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacggtccagcggctgttgccggtgctgtgccaggcccacggcttgaccccggagcaggtggtggccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37147 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgccccatcccacgctccttctcctcttcgacatcctcgtctcctcctccctctaccacctctccacagcctacttccctctcctcccccaccctctcccttccctcgcctgacccctctactgggcctgccaaggctgcgtcctaacgggcctctgggtcatcgcccacgaatgcggccaccacgccttcagcgactac

SEQ ID NO: 37148 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcacagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37149 - DNA, 435 bp, Artificial
  Mutation in BnaC.FAD2.b introduced by TALE nuclease pair BnFAD2_T03
caggatccatgggtgcaggtggaagaatgcaagtctctcctcactccagctcccccggaaccaacaccctcaaacgcgtcccctgcgagacaccaccattcactcggtccagcggctgttgccggtgctgtgccaggcccacggcttgaccccccagcaggtggtggccatcgccagcaatggcggtggcaagcaggcgctggagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37150 - DNA, 333 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactctcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37151 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatcggagacctcaagaaagcaatcccacctcactgcttcaaacgctccatcccacgctccttctcctcttcgacatcatcatctcctcctcggctcctccctctaccacctctccacagcctacttccctctcctcccccaccatctcccttacctcgcctggcctctctactgggcctgccaagggtgcgtcctaaccggcgtctgggtcatagcccacgagtgcggccaccacgccttcagcgactac

SEQ ID NO: 37152 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37153 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactctcggcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37154 - DNA, 337 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtcccctgcgagacaccacccttcactctagaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37155 - DNA, 349 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactgagacctcaagaaagcaatcccacctcactgcttcaaacgctccatccctcgctccttctcctacctcctctacgacatcctcgtctcctcctccctctaccacctctccacagcctacttccctctcctcccccaccctctccctttcctcgcctggcccctctactgggcctgccaaggctgcgtcctcacgggcctctgggtcatcgcccacgaatgcggccaccacgccttcagcgactac

SEQ ID NO: 37156 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37157 - DNA, 411 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagccgaacgaccgagcgcagcgagtcagtgagcgaggaagcggaagagcgcccaatacgcggagacctcaagaaagcaatcccacctcactgcttcaaacgctccatccctcgctccttctcctacctcctcttcgacatcctcgtctcctcccccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37158 - DNA, 367 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctgaatgcatctagatccaatgatcatgagcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37159 - DNA, 342 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagcccacgagtgcgtccaccacgccttcagcgactac

SEQ ID NO: 37160 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcggggtcatagcccacgagtgcggccaccacgccttcagcgactac

SEQ ID NO: 37161 - DNA, 320 bp, Artificial
  Mutation in BnaC.FAD2.b introduced by TALE nuclease pair BnFAD2_T03
caggatccatgggtgcaggtggaagaatgcaagtctctcctccctccagctcccccgaaacaacaacctcaaacgcgtcccctgcgagacaccatgacagacctcaagaaagcaatcccacctcactgcttcaaacgctccatcccacgctccttctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37162 - DNA, 340 bp, Artificial
  Mutation in BnaC.FAD2.b introduced by TALE nuclease pair BnFAD2_T03
caggatccatgggtgcaggtggaagaatgcaagtctcacctccctccagctcccccgaaaccaaaaccctcaaacgcgtcccctgcgagacaccacccttcactcacctcaagaaagcaatcccaccgcactgtttcaaacgctcgatccctcgctctttctcctacctcatctgggacatcatcatagcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37163 - DNA, 429 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcgctggagacggtccagcggctgttgccggtgctgtgccaggcccacggcttgaccccccagcaggtggtggccatagacctcaagaaagcaatcccacctcactgcttcaaacgctccatccctcgctccttctcctacctcctctccgacatcctcgtctcctcctccctctaccacctctccacagcctacttccctctcctcccccaccctctcccttacctcgcctggcccctctactgggcctgccaaggctgcgtcctaacgggcctccgggtcatagcccacgagtgcggccaccacgccttcagcgactac

SEQ ID NO: 37164 - DNA, 338 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtcccctgcgagacaccacccttcaagaaagcaatcccacctcactgcttcaaacgctccatccctcgctccttctcctacctactcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37165 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgtgcctctgggtcatcgcccacgaatgcggccaccacgccttcagcgactac

SEQ ID NO: 37166 - DNA, 346 bp, Artificial
  Mutation in BnaC.FAD2.b introduced by TALE nuclease pair BnFAD2_T03
caggatccaagggtgcaggtggaagaatgcaagtgtctcctccctccaagaagtctgaaaccgacaccatcaagcgcgtaccctgcgagacaccgcccttccctcaagaaagcaatcccacctcactgcttcaaacgctccatcccacgctccttctcctcttcgacatcatcatctcctcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37167 - DNA, 296 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccctcaaacgcgtcccctgcgagacaccaccatcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 37168 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccagggctgcgtcctaaccggcgtctgggtcatagcccacgagtgcggccaccacgccttcagcgactac

SEQ ID NO: 37169 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaactcctccctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37170 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcggcgactac

SEQ ID NO: 37171 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgccgggcctctctactgggcctgccagggctgcgtcctaaccggcgtctgggtcatagcccacgagtgcggccaccacgccttcagcgactac

SEQ ID NO: 37172 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcggggtcatagcccacgagtgcggccaccacgccttcagcgactac

SEQ ID NO: 37173 - DNA, 295 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctccacctcactgcttcaaacgctccatccctcgctccttctcctacctcctcttcgacatcctcgtctcctcctccctctaccacctctccacagcctacttccctctcctccccccccctctcccttacctcgcctggcccctctactgggcctgccaaggctgcgtcctaacgggcctctgggtcatagcccacgagtgcggccaccacgccttcagcgactac

SEQ ID NO: 37174 - DNA, 332 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcgtgccaaggctgcgtcctaacgggcctctggggcatagcccacgagtgcggccaccacgcctgcagcgactac

SEQ ID NO: 37175 - DNA, 431 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggcaggtggtggccatcgccagcaatggcggtggcaagcaggcgctggagacggtccagccgctgttgccggtgctgttccaggcccccggctagacctcaacaaagcaatcccacctcactgcttcaaacgctccatcccacgctccttctcctcttcgacatccccaccccctcctcggctcctccccctcccacctccccacagcctacttccctctcccttacctcgcctgacccctctactgggcctgccaaggctgcgtcctaaccggcgtctgggtcatagcccacgagtgcggccaccacgccttcagcgactac

SEQ ID NO: 37176 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37177 - DNA, 343 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctccatccctcgctccttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatagccaacgagtgcggccaccacgccttcagcgactac

SEQ ID NO: 37178 - DNA, 348 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37179 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37180 - DNA, 335 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37181 - DNA, 421 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaggccgccattgctggcgatggccaccacctgctgaggggtcacgccgtgggcctggcacagcaccggcaacagccgagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37182 - DNA, 345 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37183 - DNA, 476 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttaggcgacttttgaacgcgcaataatggtttctgacgtatgtgcttgcccacggcttgaccccggagcaggtggtggccatcgccagccacgatggggcgctggcaagtgtagtggttacgcgcaagacctcaagaaagcaatcccacccccctgcttcaaacgctccatcccacgctccttctcccctccgacatcatcatctccgcctcggctcctccctctaccccctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37184 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatttcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 37185 - DNA, 334 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37186 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37187 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaggcgctggagacctcaaggaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37188 - DNA, 329 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37189 - DNA, 305 bp, Artificial
  Mutation in BnaC.FAD2.b introduced by TALE nuclease pair BnFAD2_T03
caggatccatgggtgcaggtggaagaatgcaagtctctcctccctccagctcccccggaactaacaccctcaaacgcgtcccctgcgagacaccaccattcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 37190 - DNA, 278 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 37191 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 37192 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 37193 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37194 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccatctcccttacctcgcctgacccctctactgggcctgccaaggctgcgtcctaacgggcctctgggtcatagcccacgagtgcggccaccacgccttcagcgactac

SEQ ID NO: 37195 - DNA, 439 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaggctccgcccccctgacgagcatcacaaaaatcgacgctcaagtcagaggtggcgaaacccgacaggactataaagataccaggcgtttccccctcaagaaagcaatcccacctcactgcttcaaacgctccatcccacgctccttcccctacctcccctccgacatcctcgtctcctcctccctctaccacctctccacagcctacttccctcccctcccccaccctctcccttacctcgcctgacccctctactgggcctgccaaggctgcgtcctaacgggcctctgggtcatagcccacgagtgcggccaccacgccttcagcgactac

SEQ ID NO: 37196 - DNA, 424 bp, Artificial
  Mutation in BnaC.FAD2.b introduced by TALE nuclease pair BnFAD2_T03
caggatccatgggtgcaggtgcaagaatgcaagtctctcctccctccagctcccccgaaaccaaaaccctcaaacgcgtcccctgcgagacaccacccttcactctcggcaacagccgctggaccgttgctgtgccaggcccacggcttgaccccccagcaggtggtggccatcgccagcaatggcggtggcggagacctcaagaaagcaatcccacctcactgcttcaaacgctccatcccacgctccttctcctcttcgacatcatcatctcctcctcggctcctccccctcccccctctccccagcctacttccctctcccttccctcgcctgacccctctactgggcctgccaaggctgcgtcctaacgggcctctgggtcatagcccacgagtgcggccaccacgccttcagcgactac

SEQ ID NO: 37197 - DNA, 343 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37198 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccctaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37199 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaacctcacacgcgtcccctgcgagacaccacccttcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaaggcggccaccacgcctgcagcgactac

SEQ ID NO: 37200 - DNA, 402 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggctgttgccggtgctgtgccaggcccacggcttgaccccccagcaggtggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 37201 - DNA, 329 bp, Artificial
  Mutation in BnaC.FAD2.b introduced by TALE nuclease pair BnFAD2_T03
caggatccatgggtgcaggtggaagaatgtaagtgtctcctccctccaaaaagtctgaaaccgacaacatcaagcgcgtaccctgcgagacaccgcccgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37202 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactggacctgccaaggctgcgtcctaacgggcctctgggtcatagcccacgagtgcggccaccacgccttcagcgactac

SEQ ID NO: 37203 - DNA, 386 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactctggcaacgctgcgatcatgtcctgatacttgacagcgacggtccctatcgcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 37204 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcaagacctcaagaaagcaatcccgcctcactgcttcaaacgctccatcccacgctccttctcctcttcgacatcatcatctcctcctcgcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37205 - DNA, 257 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcctcggctcctccctctcccccctcgccccagcctacttccctctcccttacctcgcctgacccctctactgggcctgccaaggctgcgtcctaacgggcctctgggtcatagcccacgagtgcggccaccacgccttcagcgactac

SEQ ID NO: 37206 - DNA, 322 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaagcgcgtcccctgcgagacaccacctcaagaaatcaatccaacctcgctgcttcaaacgctccatcccacgctccttctcctcttcgacatcatcatctcctcctcgtctcctccccctaccacctctccacagcctccttccctctcccttacctcgcctgacccctctactgggcctgccaagcctgcgtcctaacgggcctctgggtcatagcccacgagtgcggccaccacgccttcagcgactac

SEQ ID NO: 37207 - DNA, 376 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcacttccgtgggcctggcacagcaccggcaacagccgctggagacgagacctcaagaaagcaatcccacctcactgcttcaaacgctccatcccacgctccttctcctcttcgacatcatcatctcctcctcggctcctccctctaccacctctccacagcctacttccctctcccttccctcgcctgacccctctacggggcctgccaaggctgcgtcctaaccggcgtctgggtcatagcccacgagtgcggccaccacgccttcagcgactac

SEQ ID NO: 37208 - DNA, 265 bp, Artificial
  Mutation in BnaC.FAD2.b introduced by TALE nuclease pair BnFAD2_T03
caggatccatgggtgcaggtggaagaatgcaagtctcgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37209 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37210 - DNA, 336 bp, Artificial
  Mutation in BnaC.FAD2.b introduced by TALE nuclease pair BnFAD2_T03
caggatccatgggtgcaggtggaagaatgcaagtctctcatccctccagctcccccggaaccaacaccctcaaacgcgtcccatgcgagacaccaccattcactcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37211 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccatcaaacgcgtcccctacgagacaccacccttcactcaagaaagcaatcccacctcactgcttcaaacgctccatccctcgctccttctcctacctcctcttcgacatcctcgtctcctcctccctctacaacctctccacagcctacttccctctcctcccccaccctctcccttacctcgcctggcccctctactgggcctgccaaggctgcgtcctaacgggcctctggttcatagcccacaagtgcggccaccgcgccttcagcgactac

SEQ ID NO: 37212 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaacgggcctctgggtcatcgcccacgaatgcggccaccacgccttcagcgactac

SEQ ID NO: 37213 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37214 - DNA, 280 bp, Artificial
  Mutation in BnaC.FAD2.b introduced by TALE nuclease pair BnFAD2_T03
caggatccatgggtgcaggtggaagaatgcaagtctctcctccctccagtctctccacctcactgcttcaaacgctccatcccacgctccttctcctcttcgacatcatcatctcctcctcggctcctccctctaccacctctccacagcctacttccctctcctccctcaccctctctcctacttcgcccggcctctctactgggcctgccaaggctgcgtcctaacgggcctctgggtcatcgcccacgaatgcggccaccacgccttcagcgactac

SEQ ID NO: 37215 - DNA, 468 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggattgcaaaacgtggcggcgtgaccgcagtggaggcagtgcatgcatggcgcaatgcactgacgggtgccccgctcaacttgaccccccagcaggtggtggccatcgccagcacggagaactcaagaaagcaatcccacctcactgcttcaaacgctccatccctcgctccttctcctacctcccctccgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37216 - DNA, 338 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 37217 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37218 - DNA, 372 bp, Artificial
  Mutation in BnaC.FAD2.b introduced by TALE nuclease pair BnFAD2_T03
caggatccatgggtgcaggtggaagaatgcaagtctctcctccctctagctcccccgaaaccaaaaccctcaaacgcgtcccctgcgagacaccacccttcactctcggtttcccgactggaaagcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37219 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccccgcctggcccctctactgggcctgccaaggctgcgtcctaacgggcctctgggtcatcgcccacgaatgcggccaccacgccttagcgactac

SEQ ID NO: 37220 - DNA, 301 bp, Artificial
  Mutation in BnaC.FAD2.b introduced by TALE nuclease pair BnFAD2_T03
caggatccatgggtgcaggtggaagaatgcaagtctctcctccctcccgtccccccggaaacaacaccctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgtcaaggctgcgtcctaacgggcctctgggtcatcgcccacgaatgcggccaccacgccttcagcgactac

SEQ ID NO: 37221 - DNA, 401 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactctcggggtcaagccgtgggcctggcacagcaccggcaacagccgctggaccgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37222 - DNA, 306 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 37223 - DNA, 336 bp, Artificial
  Mutation in BnaC.FAD2.b introduced by TALE nuclease pair BnFAD2_T03
cagggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 37224 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctgacctcaagaaagcaatcccacctcactgcttcaaacgctccatcccaccctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37225 - DNA, 301 bp, Artificial
  Mutation in BnaC.FAD2.b introduced by TALE nuclease pair BnFAD2_T03
caggatccatgggtgcaggtggaagaatgcaagtctctcctccctcccgtccccccggaaacaacaccctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggactgccaaggctgcgtcctaacgggcctctgggtcatagcccacgagtgcggccaccacgccttcagcgactac

SEQ ID NO: 37226 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccatctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37227 - DNA, 350 bp, Artificial
  Mutation in BnaC.FAD2.b introduced by TALE nuclease pair BnFAD2_T03
caggatccatgggtgcaggtgcaagaatgcaagtctctcctccctccagctcccccggaaccaacaccctcaaacgcgtcccctgcgagacaccaccattcactcttgacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccagggctgcgtcctaaccggcgtctgggtcatagcgcacgagtgcggccaccacgcctgcagcgactac

SEQ ID NO: 37228 - DNA, 407 bp, Artificial
  Mutation in BnaC.FAD2.b introduced by TALE nuclease pair BnFAD2_T03
caggatccatgggtgcaggtggcagaatgcaagtgtatcctccctccaaaaagtctgaaaccgacaccatcaagcgcgtaccctgcgagacaccgcccttcactggctggcgatggccaccacctgctggggggtcaagccgtgggcctggcacagcaccggagaactcaagaaagcaatcccaccgcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgcctgcagcgactac

SEQ ID NO: 37229 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgctgccaccacgccttcagcgactac

SEQ ID NO: 37230 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37231 - DNA, 382 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctggcgatggccaccaccattcactcggggggtcaagccgtgggcctggcacagcaccggcaacagccgcagacctcaagaaagcaatcccacctcactgcttcaaacgctccatcccacgctccttctcctcttcgacatcatcatctcctcctcggctcctccctctcccacctccccacagcctacttccctctcccttacctcgcctgacccctctactgggcctgccaaggctgcgtcctaacgggcctctgggtcatagcccacgagtgcggccaccacgccttcagcgactac

SEQ ID NO: 37232 - DNA, 407 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgcaccggcaacagccgctggaccgtctccagcgcctgcttgccgccatcgtggctggcgatggccaccacctgaactcaagaaagcaatcccacctcactgcttcaaacgctccatcccacgctccttctcctcttcgacatcatcatctcctcctcggctcctccccctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37233 - DNA, 294 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 37234 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgcctgcagcgactac

SEQ ID NO: 37235 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactctacctcaagaaagcaatcgcacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37236 - DNA, 333 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagtgactac

SEQ ID NO: 37237 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaattccacctcactgcttcaaacgctccatccctcgctccttctcctacctcctcttcgacatcctcgtctcatcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 37238 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37239 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccacctcactgcttcaaacgctccatccctcgctccttctcctacctcatctgggacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37240 - DNA, 397 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacccttcactctcggcaccctgaccctggaggagttgactgatagtgacctgttcgttgcaacaaattgataagcacctcaagaaagcaatcccacctcactgcttcaaacgctccatcccacgctccttctcctcttcgacatcatcatctcctcctcggctcctccctctcccacctctccacagcctacttccctctcccttacctcgcctgccccctctactgggcctgccaaggctgcgtcctaacgggcctctgggtcatagcccacgagtgcggccaccacgccttcagcgactac

SEQ ID NO: 37241 - DNA, 334 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccatttcggagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 37242 - DNA, 334 bp, Artificial
  Mutation in BnaC.FAD2.b introduced by TALE nuclease pair BnFAD2_T03
caggatccatgggtgcaggtggaagaatgcaagtctctcctctctccagctcccccggaaccaacaccctcaaacgcgtcccctgcgagacaccaccattcactctacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37243 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactggtcctgccaaggctgcgtcctaacgggcctctgggtcatagcccacgagtgcggccaccacgcctgcagcgactac

SEQ ID NO: 37244 - DNA, 324 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37245 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactaaagcaatcctacctcacttcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37246 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37247 - DNA, 265 bp, Artificial
  Mutation in BnaC.FAD2.b introduced by TALE nuclease pair BnFAD2_T03
caggatccatgggtgcaggtggaagaatgcaagtctctcctccctccagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 37248 - DNA, 349 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 37249 - DNA, 296 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 37250 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 37251 - DNA, 335 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcggcctaacgggcctctgggtcatagcccacgagtgcggccaccacgccttcagcgactac

SEQ ID NO: 37252 - DNA, 331 bp, Artificial
  Mutation in BnaC.FAD2.b introduced by TALE nuclease pair BnFAD2_T03
caggatccatgggtgcaggtggaagaatgcaagtctctcctcccttcagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcgcacgagtgcggccaccgctccttcagcgactac

SEQ ID NO: 37253 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37254 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccatcaaacgcgtcccctgcgagacaccaccattcactgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37255 - DNA, 351 bp, Artificial
  Mutation in BnaC.FAD2.b introduced by TALE nuclease pair BnFAD2_T03
caggatccatgggtgcaagtggaagaatgcaagtctctcctccctccagctcccccggaaccaacaccctcaaacgcgtcccctgcgagacaccaccattcacctggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37256 - DNA, 348 bp, Artificial
  Mutation in BnaC.FAD2.b introduced by TALE nuclease pair BnFAD2_T03
caggatccatggggcaggtggaagaatgcaattctctcctccctctagctccctcgaaaccaaaaccctcaaacgcgtcccctgcgagacaccacccttcactgagacctcaagaaagcaatcccacctcactgcttcaaacgctccatcccacgctccttctcctacctcctcttcgacatcctcgtctcctcctccctctaccacctctccacgtcctacttccctctcctcccccaccctctcccttacctcccctggcccctctaccgggcctgccaaggctgcgtcctaacgggcctctgggtcatcgcccacgaatgcggccaccactccttcagcgactac

SEQ ID NO: 37257 - DNA, 313 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctcaccctctctcctacttcgcctggcctctctactgggcctgccagggctgcgtcctaaccggcgtctgggtcatagctcacgagtgcggccaccacgccttcagcgactac

SEQ ID NO: 37258 - DNA, 349 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagccaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacggggcctgccaaggctgcgtcctgacgggcctcggggtcatcgcccacgaatgcgtccaccacgccttcagcgactac

SEQ ID NO: 37259 - DNA, 265 bp, Artificial
  Mutation in BnaC.FAD2.b introduced by TALE nuclease pair BnFAD2_T03
caggatccatgggtgcaggtggaagaatgcaagtctctcctccctccagtctctccacctcactgcttcaaacgctccatcccacgctccttctcctcttcgacatcatcatctcctcctcggctcctacctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37260 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagtccacgagtgcggccaccacgccttcagcgactac

SEQ ID NO: 37261 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37262 - DNA, 276 bp, Artificial
  Mutation in BnaC.FAD2.b introduced by TALE nuclease pair BnFAD2_T03
caggatccatgggtgcaggtggaagaatgcaagtctctcctctcggagacctcaagaaagcaatccaacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37263 - DNA, 333 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccacctcactgcttcaaacgctccatcccacgctccttctcctcttcgacatcatcatctcctcctcggctcctccctctaccacctctccacagcatacttccctctcccttacctcgcctgacccctctactgggcctgccaaggctgcgtcctaacgggcctctgggtcatcgcccacgaatgcggcctccacgccttcagcgactac

SEQ ID NO: 37264 - DNA, 344 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccattaagccacgatggcggcaagcaggcgctggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37265 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 37266 - DNA, 397 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagccgaacgaccgagcgcagcgagtcagtgagcgaggaagcggaagagcgcccaatacgcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37267 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgtgagacaccacccttcactaacctcaagaaagcaatcccacctcactgcttcaaacgctccatcccacgctccttctcctcttcgacatcatcatctcctcctcggctcctccctctaccacctctccacagcctacttccctcccccttacctcgcctgacccctctactgggcctgccaaggctgcgtcctaacgggcctctgggtcatagcccacgagtgcggccaccacgccttcagcgacta

SEQ ID NO: 37268 - DNA, 426 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctccccccagcaggtggtggccatcgccagcaatggcggtggcaagcaggcgctggagacggtccagcggctgttgccggtgctgtgccaggagacctcaagaaagcaatcccacctcactacttcaaacgctccatcccacgctccttctcctcttcgacatcagcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37269 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 37270 - DNA, 371 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctcggcgggtgtggtggttacgtagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacggggcctgccaaggctgcgtcctaaccggcctcggggtcatagcccacgagggcggccaccacgccttcagcgactac

SEQ ID NO: 37271 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactcagacctcaagaaagcaatcccaccgcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37272 - DNA, 335 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctgacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37273 - DNA, 415 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcaactatcgtcttgagtccaacccggtaagacacgacttatcgccactggcagcagccactggtaagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 37274 - DNA, 265 bp, Artificial
  Mutation in BnaC.FAD2.b introduced by TALE nuclease pair BnFAD2_T03
caggatccatgggtgcaggtggaagaatgcaagtctctcctccctccagtctctccacctaactgcttcaaacgctccatcccacgctccttctcctcttcgacatcatcatctcctcctcggctcctccatctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37275 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaagcgcgtaccctgcgagacaccgcccttcagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37276 - DNA, 317 bp, Artificial
  Mutation in BnaC.FAD2.b introduced by TALE nuclease pair BnFAD2_T03
caggatccattggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37277 - DNA, 333 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37278 - DNA, 337 bp, Artificial
  Mutation in BnaC.FAD2.b introduced by TALE nuclease pair BnFAD2_T03
caggatccatgggtgcaggtgcaagaatgcaagtctctcctcactccagctcccccgaaaccaaaaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37279 - DNA, 351 bp, Artificial
  Mutation in BnaC.FAD2.b introduced by TALE nuclease pair BnFAD2_T03
caggatccatgggtgcaggtggaagaatgcaagtgtctactccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgcctgcagcgactac

SEQ ID NO: 37280 - DNA, 335 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37281 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccctgacctcaagaaagcaatcccacctcactgcttcaaacgctccatccctcgctccttttcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37282 - DNA, 343 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactccagaactcaagaaagcaatcccaccgcactgtttcaaacgctcgatccctcgctctttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37283 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggtcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccttccaaggctgcgtcctaacgggcctctgggtcatagcccacgagtgcggccaccacgccttcagcgactac

SEQ ID NO: 37284 - DNA, 337 bp, Artificial
  Mutation in BnaC.FAD2.b introduced by TALE nuclease pair BnFAD2_T03
caggatccatgggtgcaggtggaagaacgcaagtctctcctccctccagctcccccgaaaccaaaaccctcaaacgcgtcccctgcgagacggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37285 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtaccctgcgagacaccaccattcactcacctcaagaaagcaatcccacctcactgcttcaaacgctccagccctcgctctttctcctacctccacttcgacatcgtcgtctccacctccctctaccacctctccaccgcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37286 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctataccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37287 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37288 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttagaactcaagaaagcaatcccaccgcactgcttcaaacgctcaatccctcgctccttctcctacctcctcttcgacatcctcgtctcctcctccctctaccacctctccacagcctacttccctctcctcccccaccctctcccttacctcgcctggcccctctactgggcctaccaaggctgcgtcctaacgggcctctgggtcatagcccacgagtgcggccaccacgccttcagcgactac

SEQ ID NO: 37289 - DNA, 351 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttaccgcgcctggcccctctactgggcctgccaaggctgcgtcctaacgggcctctgggtcatcgcccacgaatgcggccaccacgccttcagcgactac

SEQ ID NO: 37290 - DNA, 399 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactctcggcccactgcttgaccccccagcaggtggtggccatcgccaccaatggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37291 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 37292 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaaacgcgtcccctgttatcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagcctgcgtcctaacgggcctctgggtcatcgcccacgaatgcggccaccacgccttcagcgactac

SEQ ID NO: 37293 - DNA, 274 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaaccggcgtctgggtcatagcccacgagtgcggccaccacgcctgcagcgactac

SEQ ID NO: 37294 - DNA, 336 bp, Artificial
  Mutation in BnaC.FAD2.b introduced by TALE nuclease pair BnFAD2_T03
caggatccatgggtgcaggtgcaagaatgcaagtctctcctccctccagctcccccgaaaccaaaaccctcaaacgcgtcccctgcgagacaccacccttcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37295 - DNA, 300 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37296 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37297 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37298 - DNA, 410 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagttgccggtgctgtgccaggcccacggcttgaccccccagcaggtggtggccatcgccagcagacctcaagaaagcaatcccacctcactgcttcaagcgctccatccctcgctccttctcctacctcctcttcgacatcctcgtctcctcccccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37299 - DNA, 395 bp, Artificial
  Mutation in BnaC.FAD2.b introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactcgggtcaagccgtgggcctggcacagcaccggcaacagccgctggagagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaagggtgcgtcctaaccggcgtctgggtcatagcccacgagtgcggccaccacgccttcagcgactac

SEQ ID NO: 37300 - DNA, 336 bp, Artificial
  Mutation in BnaC.FAD2.b introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgtcggaactcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37301 - DNA, 345 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttgagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgctcacgaatgcggccaccacgccttcagcgactac

SEQ ID NO: 37302 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagccctcaagaaagcaatcccacctcactgcttcaaacgccccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37303 - DNA, 329 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37304 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgtcaaggctgcgtcctaacgggcctctgggtcatagcccacgagtgcggccaccacgccttcagcgactac

SEQ ID NO: 37305 - DNA, 331 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacctcaagaaagcaatcccacctcactgcttcaaacgctccatccctcgctccttctcctacctcctcttcgacatcctcgtctcctcctccctctaccgcctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 37306 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 37307 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccagacctcaagaaagcaatcccacctcactgcttcaaacgctccatccctcgctccttctcctacctcctcttcgacatcctcgtctcctcctccctctaccacctctccacagcctacttccctctcctcccccaccctctcccttgcctcgcctggcccctctactgggcctgccaaggctgcgtcctaacgggcctctgggtcatcgcccacgaatgcggccaccacgccttcagcgactac

SEQ ID NO: 37308 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37309 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37310 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37311 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgtcaaggctgcgtcctaacgggcctctgggtcatcgcccacgaatgcggccaccacgccttcagcgactac

SEQ ID NO: 37312 - DNA, 336 bp, Artificial
  Mutation in BnaC.FAD2.b introduced by TALE nuclease pair BnFAD2_T03
cagaatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactggtcctgccaaggctgcgtcctaacgggcctctgggtcatagcccacgagtgcggccaccacgccttcagcgactac

SEQ ID NO: 37313 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 37314 - DNA, 348 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37315 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37316 - DNA, 401 bp, Artificial
  Mutation in BnaC.FAD2.b introduced by TALE nuclease pair BnFAD2_T03
caggatccataggtgcaggtggaagaatgcaagtctctactccctccagctcccccggaaccaacaccctaaaacgcgtcccctgcgagacaccaccattcactctcggagacggtccagcggctgttgccggtgctgtgccaggcccacggtccagcgcctgcttgccggagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37317 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37318 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37319 - DNA, 429 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcactgccaggcgtcaaactaagcagaaggccatccgtcaccagcggctgttgccggtgctgtgccaggcccacggcttgaccccggagcaggtggagacctcaagaaagcaatcccacctcactgcttcaaacgctccatcccacgctcctgctcctcttcgacatcatcatctcctcctcggctcctccctctcccacctctccacagcctacttccctctcccttacctcgcctgacccctctcctgggcctgccaaggctgcgtcctaacgggcctctgggtcatagcccacgagtgcggccaccacgccttcagcgactac

SEQ ID NO: 37320 - DNA, 325 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 37321 - DNA, 362 bp, Artificial
  Mutation in BnaC.FAD2.b introduced by TALE nuclease pair BnFAD2_T03
caggatccatgggtgcaggtggaagaatgcaagtctctcctccctccagctccccgggaaccaacaccctcaaacgcgtcccctgcgagacaccaccattcactctcgggtcggagacctcaagaaagcaatcccacctcactgcttcaaacgctccatcccacgctccttctcctcttcgacatcatcatctcctcctcggctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37322 - DNA, 300 bp, Artificial
  Mutation in BnaC.FAD2.b introduced by TALE nuclease pair BnFAD2_T03
caggatccatgggtgcaggtggcagaatgcaagtctctactccctccagctcccccgaaaccaaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37323 - DNA, 417 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgcccacggcttgaccccggagcaggtggtggccatcgccagccacgatggcggcaagcaggcgctggaagaactcaagaaagcaatcccaccgcactgtttcaaacgctcgatccctcgctctttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37324 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgggagacaccacccttcacttaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37325 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaacgggcctctgggtcatagcccacgagtgcggccaccacgccttcagcgactac

SEQ ID NO: 37326 - DNA, 371 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgccggtgctgtgccaggcccagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 37327 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 37328 - DNA, 350 bp, Artificial
  Mutation in BnaC.FAD2.b introduced by TALE nuclease pair BnFAD2_T03
caggatccatgggtgcaggtgacagaatgcaagtctctcctccctccagctcccccggaaccaacaccctcaaacgcgtcccctgcgagacaccacccttcactcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37329 - DNA, 339 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37330 - DNA, 329 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaacgcgtcccctgcgagacaccaccattcactctcggaaagcaatcccacctcactgcttcaaacgctccatcccacgctccttctcctcttcgacatcatcatctcctcctcggcttctccctctaccacctctccgcagcctacttccctctcccttacctcgcctgacccctctactgggcctgccaaggctgcgtcctaacgggcctctgggtcatagcccacgagtgcggccaccacgccttcagcgactac

SEQ ID NO: 37331 - DNA, 350 bp, Artificial
  Mutation in BnaC.FAD2.b introduced by TALE nuclease pair BnFAD2_T03
caggatccatgggtgcaggtgacagaatgcaagtgtcaactccctccaagaagtctgaaaccgacaacatcaagcgcgtaccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctcggggtcatcgcccacgaatgcggccaccacgccttcagcgactac

SEQ ID NO: 37332 - DNA, 425 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactctcggtcgttcggctgcggcgagcggtatcagctcactcaaaggcggtaatacggttatcacctgtcgcaaatatagtaaaacacttatagagacctcaagaaagcaatcccacctcactgcttcaaacgctccatcccacgctccttctcctcttcgacatcatcatctcctcctcggctcctccctctcccacctctccccagcctacttccctctcccttacctcgcctgacccctctactgggcctgccaaggctgcgtcctaacgggcctctgggtcatagcccacgagtgcggccaccacgccttcagcgactac

SEQ ID NO: 37333 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcccggcccctctactgggcctgccaaggctgcgtcctaacgggcctctgggtcatagcccacgagtgcggccaccacgccttcagcgactac

SEQ ID NO: 37334 - DNA, 335 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37335 - DNA, 335 bp, Artificial
  Mutation in BnaC.FAD2.b introduced by TALE nuclease pair BnFAD2_T03
caggatccatgggtgcaggtggaagaatgcaagtctatcctccctccagctcccccggaaccaacaccctcaaacgcgtcccctgcgagacaccaccattcactcagacctcaataaagcaatcccacctcactgcttcaaacgctccatcccacgctccttctcctcctcgacatcatcatctcctcctcggctcctccctctccaacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37336 - DNA, 317 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37337 - DNA, 357 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcctttttacggttcctctccctcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37338 - DNA, 397 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggatcagggcgagataactgggcaacaatgctctccagcgccggcctgccgccgccattgagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37339 - DNA, 317 bp, Artificial
  Mutation in BnaC.FAD2.b introduced by TALE nuclease pair BnFAD2_T03
caggatccatgggtgcaggtggaagaatgcaagtctctactcactccagcgcccccgggacaaacaccctcaaacgcggcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgaccactctactgggcctgccaaggctgcgtcctaacgggcctctgggtcatagcccacgagtgcggccaccacgccttcagcgactac

SEQ ID NO: 37340 - DNA, 303 bp, Artificial
  Mutation in BnaC.FAD2.b introduced by TALE nuclease pair BnFAD2_T03
caggatccatgggtgcaggtggaagaatgcaagtgtctcctccctccaaaaagcctgaaaccgacaacatcaagcgcgtaccctgcgagacaccgcccttcgctctttctactacctcatctgggacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37341 - DNA, 337 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 37342 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccgcgcctggcccctctactgggcctgccaaggctgcgtcctaacgggcctctgggtcatagcccacgagtgcggccaccacgcctgcagcgactac

SEQ ID NO: 37343 - DNA, 306 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtactaacgggcctctgggtcatcgcccacgaatgcggccaccacgccttcagcgactac

SEQ ID NO: 37344 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctatactgggcctgccaagactgcgtcctaacgggcctctgggtcatagcccacgagtgcggccaccacgccctcagcgactac

SEQ ID NO: 37345 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtaatagcccacgagtgcggccaccatgccttcagcgactac

SEQ ID NO: 37346 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgggaactcaagaaagcaatcccacctcactgtttcaaacgctcgatccctcgctccttctcctacctcctcttcgacatcctcgtctcctcctccctctaccacctctccacctcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37347 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcgtccaccacgccttcagcgactac

SEQ ID NO: 37348 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcgaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggttatagcccacgagtgcggccaccacgccttcagcgactac

SEQ ID NO: 37349 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgagacctcaagaaagcaatcccacctcacttcttcaaactctccatccctcgcgccttctcctacctcctcttcgccatcctcgtctcctcccccctctaccacccctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37350 - DNA, 337 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37351 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatcccacgctccttctcctcttcgcctccatcatctcctcctcggctcctccctctaccacctctccccagcctacttccctctcccttacctcgcctggcccctctactgggcctgccaaggctgcgtcctaacgggcctctgggtcatagcccacgagtgcggccaccacgccttcagcgactac

SEQ ID NO: 37352 - DNA, 336 bp, Artificial
  Mutation in BnaC.FAD2.b introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 37353 - DNA, 336 bp, Artificial
  Mutation in BnaC.FAD2.b introduced by TALE nuclease pair BnFAD2_T03
caggatccatgggtgcaggtcgaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaactggcctctgggtcatagcccacgagtgcggccaccacgccttcagcgactac

SEQ ID NO: 37354 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaaacgcgtcccctgttatcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37355 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctgagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37356 - DNA, 329 bp, Artificial
  Mutation in BnaC.FAD2.b introduced by TALE nuclease pair BnFAD2_T03
caggatccatgggtgcaggtggaagaatgcaagtgtctcctccctccaaaaagtctgaagccgacaacatcaagcgcgtaccctgcgagacaccgccctagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37357 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattaacacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37358 - DNA, 348 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37359 - DNA, 322 bp, Artificial
  Mutation in BnaC.FAD2.b introduced by TALE nuclease pair BnFAD2_T03
caggatccatgggtgcaggtggaagaatgcaagtctctcctccctccaaaaagtctgaaaccgacaacatcaagcgcgtaccctgcgagacaccacctcaagaaagcaatcccacctcactgcttcaaacgctccatcccacgctccttctcctcttcgacatcatcatctcctcctcgactcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37360 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37361 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccaccccactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccagggctgcgtcctaacgggtctctgggtcatcgcccacgaatgcggccaccacgccttcagcgactac

SEQ ID NO: 37362 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgcctgcagcgactac

SEQ ID NO: 37363 - DNA, 292 bp, Artificial
  Mutation in BnaC.FAD2.b introduced by TALE nuclease pair BnFAD2_T03
caggatccatgggtgcaggtggaagaatgcaagtctctcctccctccagctcccccggaaccaagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37364 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgacgac

SEQ ID NO: 37365 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 37366 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgtagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37367 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37368 - DNA, 376 bp, Artificial
  Mutation in BnaC.FAD2.b introduced by TALE nuclease pair BnFAD2_T03
caggatccatgggtgcaggtagaagaatgcaagcctctcctccctccagctcccccggaaccaacaccctcaaacgcgtcccctgcgagacaccaccattcactctgcgttatcccctgattctgtggataaccgtattaccgagacctcaagaaagcaatcccacctcactgcttcaaacgctccatcccacgctccttctcctcttcgacatcatcatctcctcctcggctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37369 - DNA, 336 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcattcagcgactac

SEQ ID NO: 37370 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaataaagcaatccctcctcactgcctcatacgctccatcccacgctccttctcctcttcgacatcatcatctcctcctcggctcctccctctaccacctctccacagcctacttccctctcccttacctcgcctggccccactactgggcctgccaaggctgcgtcctaacgggcctctgggtcatagcccacgagtgcggccaccacgccttcagcgactac

SEQ ID NO: 37371 - DNA, 395 bp, Artificial
  Mutation in BnaC.FAD2.b introduced by TALE nuclease pair BnFAD2_T03
caggatccatgggtgcaggtggaagaatgcaagtctctcctccctccagctccaccggaaccaacaccctcaaacgcgtcccctgcgagacaccgcccttcactcgggacaagccgtgggcctggcacagcaccggcaacagccgctggagagacctcaagaaagcaatcccacctcactgcttcaaacgctccatccctcgctccttctcctacctcccctccgacatcctcgtctcctcctccctctaccacctctccacagcctacttcccccccctccccccccctctcccttacctcgcctggcctctctactcggcctgccaagggtgcgtcctaacctgcgtctgggtcatagcccacgagtgcggccaccacaccttcagctactac

SEQ ID NO: 37372 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 37373 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccacaccctctcccttacctcgcctggcccctctactgggcctgccaaggctgcgtcctaacgggcctctgggtcatcgcccacgaatgcggccaccacgccttcagcgactac

SEQ ID NO: 37374 - DNA, 409 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactctcggctgcggcgagcggtatcagctcactcaaaggcggtaatacggttatccacagaatcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37375 - DNA, 441 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacagcaccggcaacagccgctggaccgtctccagcgcctgcttgccaccgccaagccgtgggcctggcacagcaccggcaacagccgctggacgacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37376 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgaatgcggccaccacgccttcagcgactac

SEQ ID NO: 37377 - DNA, 362 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactcaatggcggtggcaagcaggcgctggagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37378 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaacgggcctctgggtcatcgcccacgaatgcggccaccacgccttcagcgactac

SEQ ID NO: 37379 - DNA, 404 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgcaattaatacgcgtaccgctagccaggaagagtttgtagaaacgcaaaacggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37380 - DNA, 392 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctctccagcgcctgcttgccaccattattgctggcgatggccaccacctgctggggggagacctcaagaaagcaatcccacctcactgcttcaaacgctccatcccacgctccttctcctcttcgacatcatcatctcctcctcggctcctccctctaccacctctccacagcctccttccctctcccttacctcgcctgacccctctactgggcctgccaaggctgcgtcctaacgggcctctgggtcatagcccacgaatgcggccaccacgccttcagcgactac

SEQ ID NO: 37381 - DNA, 337 bp, Artificial
  Mutation in BnaC.FAD2.b introduced by TALE nuclease pair BnFAD2_T03
caggatccatggttgcaggtggaagaatgcaagtgtctcctccctccaaaaagtctgaaaccgacaacatcaagcgcgtaccctgcgagacaccacccttcactctcgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37382 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagaaagcaatcccacctcactgcttcaaacgctccatccctcgctccttctcctacctcctcttcgacatcctcgtctcctcctccctctaccacctctccacagcctacttccctctcctcccccaccctctcccttacctcccctggcccctctactgggcctgccaaggctgcgtcctaacgggcctctgggccatcgcccacgaatgcggccaccacgccttcagcgactac

SEQ ID NO: 37383 - DNA, 350 bp, Artificial
  Mutation in BnaC.FAD2.b introduced by TALE nuclease pair BnFAD2_T03
caggatccatgggtgcaggttgaagaatgcaagtgtctcctccctccaagaagtctgaaaccgacaccatcaagcgcgtaccctgcgagacaccgcccttcactgtagaactcaagaaagcaatcccacctcactgcttcaaacgctccatccctcgctccttctcctacctcctcttcgacatcctcgcctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 37384 - DNA, 384 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccgtccagcggctgttgccggtgttgtgcctggcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 37385 - DNA, 398 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgccccgctcaacttgaccccccagcaggtggtggccatcgccagcaataatggtggcaagcagaactcaagaaagcaatcccacctcactgcttcaaacgctccatcccacgctccttctcctcttcgacatcatcatctcctcctcggctcctccctctaccacctctccacagcctacttccccctcccttacctcgcctggcccctctactgggcctgccaaggctgcgtcctaacgggcctctgggtcatagcccacgagtgcggccaccacgccttcagcgactac

SEQ ID NO: 37386 - DNA, 331 bp, Artificial
  Mutation in BnaC.FAD2.b introduced by TALE nuclease pair BnFAD2_T03
caggatccatgggtgcaggtagaagaatgcaagtctctcctccctccagctcccccggaaccaacaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccagggctgcgtcctaaccggcgtctgggtcatagcccacgagtgcggccaccacgcctgcagcgactac

SEQ ID NO: 37387 - DNA, 440 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggaccgtctcagcggctgttgccaccgccattgctggcgatgaccaccacctgctggtagcggtggtttttttgtttgcaagcagcagattacgcgcagaaggagacctcaagaaagcaatcccacctcactgcttcaaacgctccatcccacgctccttctcctcttcgccatcatcacctcctcctcggctcctccctctcccacctctccacagcctccttccctctcccttaccgcgcctgacccctctacggggcctgccaaggctgcgtcctaacgggcctctgggtcatagcccacgagtgcggccaccacgccttcagcgactac

SEQ ID NO: 37388 - DNA, 395 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgggtcaagccgtgggcctggcacagcaccggcaacagccgctggagagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37389 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctctcaagaaagcaatcccacctcactgcttcaaacgctccatccctcgctccttctcctacctcctcttcgacatcctcgtctcctcctccctctactacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37390 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccttagacctcaagaaagcaatcccacctcactgcttcaaacgctccatccctcgctcattctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37391 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacatgagacctcaagaaagcaatcccacctcactgcttcaaacgctccatcccacgctccttctcctcttcgccatcatcatctcctcctcggctcctccctctaccacctctccacagcctacttccctctcccttacctcgcctgacccctctactgggcctgccaaggctgcggcctaacgggcctctgggtcatcgcccacgaatgcgtccaccacgccttcagcgactac

SEQ ID NO: 37392 - DNA, 324 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccattcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37393 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37394 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37395 - DNA, 332 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtcccctgcgagacaccacccttcacgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 37396 - DNA, 335 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37397 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaaggcggccaccacgccttcagcgactac

SEQ ID NO: 37398 - DNA, 334 bp, Artificial
  Mutation in BnaC.FAD2.b introduced by TALE nuclease pair BnFAD2_T03
caggatccatgggtgcaggtggaagaatgcaagtctctcctccctccagcccccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37399 - DNA, 351 bp, Artificial
  Mutation in BnaC.FAD2.b introduced by TALE nuclease pair BnFAD2_T03
caggatccatgggtgcaggtggaagaatgcaagtctctcatccctccagctcccccggaaccaacaccctcaaacgcgtcccctgcgagacaccaccattcactctagacctcaagaaagcaatcccacctcactgcttcaaacgccccatccccccccccttctcctcttcgccatcatcatctcctcctcgcctcctccctctaccacctctccacagcctacttccctctcctcccacaccctctcccttccctcgcctggcccctctactgggcctgccaaggctgcgtcctaacgggcctctgggtcatagcccacgagtgcggccaccacgccttcagcgactac

SEQ ID NO: 37400 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatccctcgctccttctcctacctcctcttcgacatcatcatctcatcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37401 - DNA, 316 bp, Artificial
  Mutation in BnaC.FAD2.b introduced by TALE nuclease pair BnFAD2_T03
caggatccatgggtgcaggtgggagaatggaagtctctcctccctccagctcccccgaaaccaaaaccctcaaacgcgtcccctgcgagacctcaagaaagcaatcccacctcactgcttcaaacgctccatccctctctccttctcctacctcctcttcgacatcctcgtctcctcctccctctaccacctctccacagcctacttccctctcccttacctcgcctgacccctctgctgggcctgccaatgctgcgtcctaacgggcctctgggtcatagcccaccagggcggccaccacgccttcagcgactac

SEQ ID NO: 37402 - DNA, 314 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccatcaaacgctccatcccacgctccttctcctcttcgacatcatcatctcctcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37403 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 37404 - DNA, 342 bp, Artificial
  Mutation in BnaC.FAD2.b introduced by TALE nuclease pair BnFAD2_T03
caggatccatgggtgcatgtggaagaatgcaagtctctcctccctccagctcccccggaaccaacaccctcaaacgcgtcccctgcgagacaccaccattcactctcggcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37405 - DNA, 295 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 37406 - DNA, 279 bp, Artificial
  Mutation in BnaC.FAD2.b introduced by TALE nuclease pair BnFAD2_T03
caggatccatgggtgcaggtggaagaatgcaagtctctcctccatccagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37407 - DNA, 352 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactctcagacctcaagaaagcaatcccacctcactgcttcaaacgctccatcccactctccttctcctcttcgacatcatcatctcctcctcggctcctccctctaccacctctccacagcctacttccctcgcctcccccaccctctcccttccctcgcctggcccctctactgggcctgccaaggctgcgtcctaacgggcgtctgggtcatcgcccacgaatgcggccaccacgccttcagcgactac

SEQ ID NO: 37408 - DNA, 339 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaccatcaagcgcgtaccctgcgagacaccaccactcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37409 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37410 - DNA, 333 bp, Artificial
  Mutation in BnaC.FAD2.b introduced by TALE nuclease pair BnFAD2_T03
caggatccatgggtgcgggtggaagaatgcaagtctctcctccctccagctcccccggaaccaacaccctcaaacgcgtcccctgcgagacaccaccattcactaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37411 - DNA, 407 bp, Artificial
  Mutation in BnaC.FAD2.b introduced by TALE nuclease pair BnFAD2_T03
caggatccatgggtgcaggtggaagaatgcaagtctctcctccctccagctcccccgaagccaaaaccctcaaacgcgtcccctgcgagacaccactcaaatccgctcccggcggatttgtcctactcaggagagcgttcaccgacaaacaacagataaaacgaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttagcgactac

SEQ ID NO: 37412 - DNA, 349 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 37413 - DNA, 332 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccattcacttcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37414 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcacctggcccctctactgggcctgccaaggctgcgtcctaacgggcctctgggtcatagcccacgagtgcggccaccacgccttcagcgactac

SEQ ID NO: 37415 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37416 - DNA, 349 bp, Artificial
  Mutation in BnaC.FAD2.b introduced by TALE nuclease pair BnFAD2_T03
cagatccatgggtgcaggtggaagaatgcaagtctctcctccctccagctcccccggaaccaacaccctcaaacgcgtcccctgcgagacaccacccttcactcttagacctcaagaaagcaatcccacctcactgcttcaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 37417 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37418 - DNA, 335 bp, Artificial
  Mutation in BnaC.FAD2.b introduced by TALE nuclease pair BnFAD2_T03
caggatccatgggtgcaggtggaagaatgcaagtctctcctccctccagctaccccgaaaccaacaccctcaaacgcgtcccctgcgagacaccaccattcactctgacctcaagaaagcaatcccacctcactgcttcatacgctccatcccacgctccttctcctcttcgacatcatcatcccctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37419 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgtcaaggctgcgtcctaacgggcctctgggtcatcgcccacgaatgcggccaccacgccttcagcgactac

SEQ ID NO: 37420 - DNA, 342 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgacggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37421 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37422 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgccccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37423 - DNA, 335 bp, Artificial
  Mutation in BnaC.FAD2.b introduced by TALE nuclease pair BnFAD2_T03
caggatctatgggtgcaggtggaagaatgcaagtctctcctccctccagctcccccgaaaccaaaaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37424 - DNA, 370 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcggggtcaagccgtgggcctggcacagcaccggcaacaggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37425 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaagcccacctcactgcttcaaacgctccatccctcgctccttctcctacctcctcttcgacatcctcgtctcctcctccctctaccacctctccacagcctacttccctctcctcccccaccctctcccttacctcgcctaacccctctactgggcctgccaaggctgcgtcctaacgggcctctgggtcatagcccacgagtgcggccaccacgccttcagcgactac

SEQ ID NO: 37426 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtaccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgagtgcggccaccacgccttcagcgactac

SEQ ID NO: 37427 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37428 - DNA, 337 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcacctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37429 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 37430 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37431 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37432 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgcctgcagcgactac

SEQ ID NO: 37433 - DNA, 335 bp, Artificial
  Mutation in BnaC.FAD2.b introduced by TALE nuclease pair BnFAD2_T03
caggatccatgggtgcaggtggaagaatgcaagtctctcctcccttcagctcccccggaaccaacaccctcaaacgcgtcccctgcgagacaccaccattcactgtgacctcaagaaagcaatcccacctcactgcttcaaacgctccatcccaccctcctgctcctcttcaacatcatcatcttctcctcggctcctccctctaccacctctccacagcctacttccctctcccttacctcgcctgacccctccactgggcctgcaaagactgcgtcctaacgcgcctctgggacatagcccacgagtgcggccaccacgccttcagcgactac

SEQ ID NO: 37434 - DNA, 368 bp, Artificial
  Mutation in BnaC.FAD2.b introduced by TALE nuclease pair BnFAD2_T03
caggatccatgggtgcaggtggaagaatgcaagtctctcgtccctccagctcccccgaaaccaaaaccctcaaacgcgtcccctgcgagacaccacccttcactctcgagcgccatatcgaaccgacgttgctggccgagacctcaagaaagcaatcccacctcactgcttcaaacgctccatcccacgctccttctcctcttcgacatcatcatctcctcctcggctcctccctctaccacctctccacagcctccttccctctcccttacctcgcctgacccctctactgggcctgccaagggtgcgtcctaaccggcgtctgggtcatagaccacgagtgcggccaccacgccaacagcgactac

SEQ ID NO: 37435 - DNA, 346 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37436 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 37437 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaacgggcctctgggtcatcgcccaccaatgcggccaccacgccttcagcgactac

SEQ ID NO: 37438 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37439 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctcggggtcatcgcccacgagtgcggccaccacgccttcagcgactac

SEQ ID NO: 37440 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccaccgcactgcttcaaacgctccatccctcgctccttctcctacctcctcttcgacatcctcgtctcctcctccctctaccacctcgccacagcctacttccctctcctcccccaccctctcccttccctcgcctggcccctctactgggcctgccaaggctgcgtcctaaccggcgtctgggtcatagcccacgagtgcggccaccacgccttcagcgactac

SEQ ID NO: 37441 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37442 - DNA, 402 bp, Artificial
  Mutation in BnaC.FAD2.b introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtagaaagctggtttgcatgcaggcctctgcagtcgacgggcccgggatccgaagaactcaagaaagcaatcccaccgcactgtttcaaacgctcgatccctcgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37443 - DNA, 346 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactacctcaagaaagcaatcccacctcactgcttccaacgctccatccctcgctccttctcctacctcctcttcgacatcctcgtctcctcctccctctcccacctctccacatcctacttccctcccctccccccccctctcccttacctcgcctggcccctctactgggcctgccaaggctgcgtcctaacgggcctctgggtcatagcccacgagtgcggccaccacgccttcagcgactac

SEQ ID NO: 37444 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccccctactgggcctgccacggctgcgtcctaacgggcctctgggtcatagcccacgagggcggccaccacgccttcagcgactac

SEQ ID NO: 37445 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37446 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37447 - DNA, 364 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgcgagacaccacccttcacttttggagcagcaacgatgttacgcagcaggagacctcaagaaagcaatcccacctcactgcttcaaacgctccatcccacgctccttctcctcttcgacatcatcatctcctcctcggctcctccctctaccacctctccacagcctccttccctctcccttccctcgcctgacccctctactgggcctgccaaggctgcgtcctaacgggcctctgggtcatagcccacgagtgcggccaccacgccttcagcgactac

SEQ ID NO: 37448 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcccacttccctctcctcccccaccctctcccttgcctcgcctggcccctctactgggcctgccaaggctgcgtcctaacgggcctgtgggtcatcgcccgcgaatgcggccgccacgcctcagcgactag

SEQ ID NO: 37449 - DNA, 315 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctcaccctctctcctacttcgcctggcctctctactgggcctgccagggctgcgtcctaaccggcgtctgggtcatagcccacgagtgcggccaccacgccttcagcgactac

SEQ ID NO: 37450 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37451 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 37452 - DNA, 336 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37453 - DNA, 351 bp, Artificial
  Mutation in BnaC.FAD2.b introduced by TALE nuclease pair BnFAD2_T03
caggatccattggtgcaggttgaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37454 - DNA, 268 bp, Artificial
  Mutation in BnaC.FAD2.b introduced by TALE nuclease pair BnFAD2_T03
caggatccatgggtgcaggtggaagaatgcaagtctctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37455 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 37456 - DNA, 431 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggctgttgccggtgctgtgccaggcccacggcttgaccccggagcaggtggtggccatcgccagccacgatggcggcaagagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37457 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgaacctcaagaaagcaatcccacctcactgcttcaaacgctccatccctccctccttctcctacctcctcttcgacatcctcgtctctcctccctctaccacctctccacagcctacttccctctcctcccccaccctctcccttacctcgcctgacccctctactgggccggccaaggctgcgtcctaacgggcctctgggtcatagctcacgagtgcggccaccacgccttcagcgactac

SEQ ID NO: 37458 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctccatcccacctcactgcttcaaacgctccatccctcgctccttctcctacctcctcttcgacatcctcgtctcctcctccctctaccacctctccacagcctacttccctctcccccccccccctctccctttcctcgcctggcccctctactgggcctgccaaggctgcgtcctaacgggcctctgggtcatcgcccacgaatgcggccaccacgccttcagcgactac

SEQ ID NO: 37459 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccgacctccagtaaccaatcccacctcactgcttcaaccgctccatccctcgctccttctcctacctcctcttcgacatcctcgtctcctcctccctctaccacctctccccagcctacttccctctcccttacctcgcctggcccctctactgggcctgccaagggtgcgtcctaaccggcgtcttggtcatagcccacgagtgcggccaccacgccttcagcgactac

SEQ ID NO: 37460 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37461 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgtgtcctaaccggcgtctgggtcatagcccacgagtgcggccaccacgccttcagcgactac

SEQ ID NO: 37462 - DNA, 335 bp, Artificial
  Mutation in BnaC.FAD2.b introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtgaactcaagaaagcaatcccacctcactgcttcaaacgctccatcccacgctccttctcctcttcgacatcatcatctcctcctcgcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37463 - DNA, 329 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccaacaacatcaagcgcgtaccctgcgagacaccgcccgagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 37464 - DNA, 337 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaagaactcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37465 - DNA, 432 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctcggcctggagacggtccagcggctgttgccggtgctgtgccaggcccacggcttgaccccggagcaggtggtggccatcgccagccacgatggcggagaccccaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37466 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttttggagacctcaagaaagcaatcccacctcactgcttcaaacgctccatcccacgctccttctcctcttcgacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 37467 - DNA, 333 bp, Artificial
  Mutation in BnaC.FAD2.b introduced by TALE nuclease pair BnFAD2_T03
caggatccatgggtgcatgtggaagaatgcaagtctctcctccctccagctcccccgaaaccaaaaccctcaaacgcgtcccctgcgagacaccacccttcactgacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37468 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 37469 - DNA, 349 bp, Artificial
  Mutation in BnaC.FAD2.b introduced by TALE nuclease pair BnFAD2_T03
caggatccatgggtgcaggtgtaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 37470 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacttggcctgccaaggctgcgtcctaaccggcgtctgggtcatagcccacgagtgcggccaccacgccttcagcgactac

SEQ ID NO: 37471 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaagaaagcaatcccacctcactgcttcaaacgctccatcccacgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37472 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttttcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37473 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttcccgctcccttacctcgcctgacccctctactgggcctgccaaggctgcgtcctaacgggcctctgggtcatagcccacgagtgcggccaccacgccttcagcgactac

SEQ ID NO: 37474 - DNA, 331 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 37475 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctagacctcaagaagacaatcccacctcactgcttcaaacgctccatcccaccctccttctcctcttccccatcatcctctcctcctctccccctccctctaccacctctccacaccccccttccctctccctttcctcgcctggcccctctactgggcctgccaaggctgcgtcctaaccggcctctgggtcatagcccacgagtgcggccaccacgccttcagcgaccac

SEQ ID NO: 37476 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagagctgcgtcctaaccggcgtctggctcatatcccacgagtgctgccaccacgccttcagcgactac

SEQ ID NO: 37477 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatccctcgctccttctcctacctcctcttcgacatcatcatctcctcctcggctcctccctctaccacctctccacagcctacttccctctcccttacctcgcatgacccctctactgggcctgccaaggctgcgtcctaacgggcctctgggtcatagcccacgagtgcggccaccacgccttcagcgactac

SEQ ID NO: 37478 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttgaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37479 - DNA, 344 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaacgcgtcccctgcgagacaccacccttagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37480 - DNA, 325 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaccatcaagcgcgtaccctgcgagacaccgccaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 37481 - DNA, 376 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttccgtgggcctggcacagcaccggcaacagccgctggagacgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37482 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 37483 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37484 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcacctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37485 - DNA, 400 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaggcgctggagacggtccagcggctgttgccggtgctgtgccaggcccacggcttgaccccggagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37486 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgaacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37487 - DNA, 336 bp, Artificial
  Mutation in BnaC.FAD2.b introduced by TALE nuclease pair BnFAD2_T03
caggatccatgggtgcaggtggaagaatgcaagtctctcctccctccaactcccccggaaccaacaccctcaaacgcgtcccctgcgagacaccaccattcactcgagacctcaagaaagcaatcccacctcactgcttcaaccgctccatcccaccctccttctcctcttcgccatcatcatctcctcctcgactcctccctctcccacctctccacaccctacttccctctcccttacctcgcctggcccctctactgggcctgccaaggctgcgtcctaacgggcctctgggtcatagcccacgagtgcggccaccacgccttcagcgactac

SEQ ID NO: 37488 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactctcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37489 - DNA, 314 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37490 - DNA, 335 bp, Artificial
  Mutation in BnaC.FAD2.b introduced by TALE nuclease pair BnFAD2_T03
caggatccatgggtgcaggtggcagaatgcaagtctctactctctccagctcccccggaaccaacaccctcaaacgcgtcccctgcgagacaccaccattcactcagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcggggtcatagcccacgagtgcgtccaccacgccttcagcaactac

SEQ ID NO: 37491 - DNA, 343 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37492 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37493 - DNA, 372 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggtttcccgactggaaagcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37494 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccgtcaagcgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 37495 - DNA, 351 bp, Artificial
  Mutation in BnaC.FAD2.b introduced by TALE nuclease pair BnFAD2_T03
caggatccatgggtgcaggtggaagaatgcaagtctctcctccctccggctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37496 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37497 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccaccctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37498 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37499 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctccctcctcttcgacatcctcgtctcctcctccctctaccacctctccacagcctacttccctctcctcccccgccctctcccttacctcgcctggcccctctactgggcctgccaaggctgcgtcctaaccggcgtctgggtcatagcccacgagtgcggcgaccacgccttcagcgactac

SEQ ID NO: 37500 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaagggtgcgtcctaaccggcgtctgggtcatagcccacgagtgcggccaccacgccttcagcgactac

SEQ ID NO: 37501 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcgtccaccacgcctgcagcgactac

SEQ ID NO: 37502 - DNA, 274 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcctctgggtcatagcccacgagtgcggccaccacgccttcagcgactac

SEQ ID NO: 37503 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37504 - DNA, 441 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactctcggggagaaaggcggacaggtatccggtaagcggcagggtcggaacagccgctggaccgtctccagcgcctgcttgccaccattattgctggccctcaagaaagcaatcccacctcactgcttcaaacgctccatcccacgctccttctcctcttcgacatcatcatctcctcctcggctcctccctctaccacctctccacagcctacttccctctcctcccccaccctctcccttgcctcgcctggcccctctactgggcctgccaaggctgcgtcctaacgggcctctgggtcatcgcccacgaatgcggccaccacgccttcagcgactac

SEQ ID NO: 37505 - DNA, 401 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcaactatcgtcttgagtccaacccggtaagacacgacttatcgccactggcagcagccactggtaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37506 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatctcccacgaatgcggccaccacgccttcagcgactac

SEQ ID NO: 37507 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37508 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactctcgacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 37509 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37510 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacggagacctcaagaaagcaatcccacctcactgcttcaaacgctccatccctcgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37511 - DNA, 324 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37512 - DNA, 331 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctcggggtcatagcccacgagtgcggccaccacgccttcagcgactac

SEQ ID NO: 37513 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 37514 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccagggctgcgtcctaaccggcgtctgggtcatagcccacgagtgcggccaccacgccttcagcgactac

SEQ ID NO: 37515 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttcggagacctcaagaaagcaatcccacctcactgcttcaaacgctccatcccacgctccttctcctcttcgacatcatcatctcctcctcggctcctccctcaccctctctcctacttcgcctggcctctctactgggcctgccaagggtgcgtcctaaccggcgtctgggtcatagcccacgagtgctgccaccacgccttcagcgactac

SEQ ID NO: 37516 - DNA, 363 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcgcggcgggtgtgggggttacgcgcaaagacctcaagaaagcaatcccaccgcactgcttcaaacgctccataccccgctccttctcctcttcgacatcatcatctcctcctcggctcctccccctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37517 - DNA, 401 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggagacggtccagcggctgttgccggtgctgtgccaggcccacggtccagcgcctgcttgccggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcccaacgggcctctgggtcatagcccacgagtgcggccaccacgccttcagcgactac

SEQ ID NO: 37518 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacacctacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37519 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagtgctgcgtcctaaccggcgtctgggtcatagcccacgagtgcggccaccccgccttcagccactac

SEQ ID NO: 37520 - DNA, 295 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37521 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37522 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaacgggcctctgggtcatagcccacgagtgcggccaccacgccttcagcgactac

SEQ ID NO: 37523 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctcgccacaccctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37524 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggtcggagacctcaagaaagcaatcccacctcactgcttcaaacgctccatcccacgctccttctcctcttcgacatcctcgtctcctcctccctctaccacctctccacagcctacttccctctcctcccccaccctctcccttacctcccctggcccctctactgggcctgccaaggctgcgtcctaacgggcctctgggtcatcgcccacgaatgcggccaccacgccttcagcgactac

SEQ ID NO: 37525 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 37526 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccgcgccttcagcgactac

SEQ ID NO: 37527 - DNA, 319 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37528 - DNA, 337 bp, Artificial
  Mutation in BnaC.FAD2.b introduced by TALE nuclease pair BnFAD2_T03
caggatccatgggtgcaggtgaaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctgacgagcctctgggtcatagcccacgagtgcggccaccacaccttcagcgactac

SEQ ID NO: 37529 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37530 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatcccacgctccttctcctcttcgtcaccatcatctcctcctctcctcctccctctaccacccctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 37531 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 37532 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 37533 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaacagcgtcccctgcgagacaccaccagagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37534 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacggggcctgccaaggctgcgtcctaacgggcctctgggtcatcgcccacgaatgcggccaccacgccttcagcgactac

SEQ ID NO: 37535 - DNA, 333 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactttactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37536 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccgacctcaagaaagcaatcccacctcactgcttcaaacgctccatccctcgctccttctcctacctcctcttcgacctcctcgtctcctcctccctctaccacctctccacagcctccttccctctcctcccccaccctctcccttccctcgcctgacccctctactgggcctgccaagactgcgtcctaacgcgcctctgggtcatagcccacgagtgcggccaccacgccttcagcgactac

SEQ ID NO: 37537 - DNA, 391 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctaggcgacgaggtggtcgttggtcaacgcggccaacgccgggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37538 - DNA, 392 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccagcgcctgcttgccaccattattgctggcgatggccaccacctgctggggggtcaagttgagcggggcacccgtcagtgcattgcgccagagacctcaagaaagcaatcccacctcactgcttcaaacgctccatcccacgctccttctcctcttcgacatcatcatctcctcctcggctcctccctctcccgcctccccacagcctacttccctctcccttacctcgcctgacccctctactgggcctgccaaggctgcgtcctaacgggcctctgggtcatagcccacgagtgcggccaccacgccttcagcgactac

SEQ ID NO: 37539 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcacccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37540 - DNA, 343 bp, Artificial
  Mutation in BnaC.FAD2.b introduced by TALE nuclease pair BnFAD2_T03
caggatccatgggtgcaggtggcagaatgcaagtcactcctcactccagctcccccgaaaccaaaaccctcaaacgcgtcccctgcgagacaccacccttcactctcggcctcaagaaagcaatcccacctcactgcttcaaacgctccatccctcgctccttctcctacctcctcttcgacatcatcatctcctcctcggctcctccctctaccacctctccacatcctacttccctctcccttacctcgcctgacccctctactgggcctgccaaggctgcgtcctaacgggcctctgggtcatagcccacgagtgcggccaccacgccttcagcgactac

SEQ ID NO: 37541 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatccctcgctccttctcctacctcctcttcgacatcctcgtctcctcctccctctaccacctctccacagcctacttccctctcctccctcgccctctctcctacgtcgccgggcctctctacggggcctgccaagggtgcgtcctagcgggcctctgggtcatagcccgcgagtgcggccaccacgccttcagcgactac

SEQ ID NO: 37542 - DNA, 331 bp, Artificial
  Mutation in BnaC.FAD2.b introduced by TALE nuclease pair BnFAD2_T03
caggatccatgggtgcaggcggaagaatgcaagtgactcctccctccaaaaagcctgaaaccgacaacatcaagcgcgtaccctgcgagacaccgcccttcacaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37543 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctaaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37544 - DNA, 312 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctcttcgacatcatcatctcctcctcggctcctcccccaccctctcccttacctcgcctggcccctctactgggcctgccagggctgcgtcctaaccggcgtctgggtcatagcccacgagtgcggccaccacgccttcagcgactac

SEQ ID NO: 37545 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaaccggcgtctgggtcatagcccacgagtgcggccaccacgccttcagcaactac

SEQ ID NO: 37546 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcctcaaacgctccatcccacgctccttctcctcttcgacatcatcatctcctcctcggctcctccctctaccacctctccacagcctacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 37547 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcatcccctgcgagacaccacccttcactcgacctcatgaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37548 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttctctctctcttacctcgcctgacccctctactgggcctgccagggctgcgtcctaaccggcgtctgggtcatagcccacgagtgcggccaccacgccttcagcgactac

SEQ ID NO: 37549 - DNA, 405 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactccggtccagcggctgttgccaccattattgctggcgatggccaccacctgctgtggggtcaagccgtgggcagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37550 - DNA, 415 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcgctggagacggtccagcggctgttgccggtgctgtgccaggcccacggcttgaccccccagcaggtggtggccatagacctcaagaaagcaattccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 37551 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcacctcaagaaagcaatcccacctcactgcttcaaacgctccatccctcgctccttctcctacctcctcttcgacatcctcgtctcctcctccctctaccacctctccacagcctacttccctctcctcccccaccctctcccttgcctcgcctggcccctctactgggcctgccaaggctgcgtcctaacgggcctctgggtcatcgcccacgaatgcggccaccacgccttcagcgactac

SEQ ID NO: 37552 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgacctcaagaaagcaatcccacctcactgcttcaaacgctccatcccacgctccttctcctcttcgacatcatcatctcctcctcggctcctccctctaccacctctccacagcctacttccctctcctcccccaccctctcccttgcctcgcctggcccctctactgggcctgccaaggctgcgtcctaacgggcctctgggtcatcgcccacgaatgcggccaccacgccttcagcgactac

SEQ ID NO: 37553 - DNA, 385 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgcaaatatttcttgtcaaaaatgctccactgacgttccataaattcccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 37554 - DNA, 401 bp, Artificial
  Mutation in BnaC.FAD2.b introduced by TALE nuclease pair BnFAD2_T03
caggatccatgagtgcaggtggaagaatgcaagtctctcctccctccagctcccccggaaccaacaccctcaaacgcgtcccctgcgagacaccaccattcactcttggccaccacctgctgaggggtcaagccgtgggcctggcacagcaccggcaacagccgctggaggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37555 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 37556 - DNA, 279 bp, Artificial
  Mutation in BnaC.FAD2.b introduced by TALE nuclease pair BnFAD2_T03
caggatccatgggtgcaggtggaagaatgcaagtctctcctccctccagtctctccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37557 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37558 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37559 - DNA, 363 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcggggaaccccaaaaaggcaaccccccctaccgccttcaaaccccccatccctcgcccctcctcctccccccccttcgacatctccgctccctcctcccccacccccctctcccccccctcctccccctacctccccccccctccccaccctctcccttacctcgcctggcccctctactgggcctgccaaggctgcgtcctaacgggcctctgggtcatcgcccacgaatgcggccaccacgccttcagcgactac

SEQ ID NO: 37560 - DNA, 349 bp, Artificial
  Mutation in BnaC.FAD2.b introduced by TALE nuclease pair BnFAD2_T03
caggatccatgggtgcagtggaagaatgcaagtctctcctccctccagctcccccgaaaccaaaaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37561 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcctccggaaccaacaccctcaaacgcgtcccctgcgatacaccaccattcactctagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37562 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagaaagcaatcccacctcactgcttcaaacgctccatccctcgctccttctcctatctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37563 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacactacccttcactcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37564 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37565 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtccactgcgagacaccaccattcactcctcaagaaagcaatcccacctcactgcttcaaacgctccatcccacgctccttctcctcttcgacatcatcatctcctcctcggcgcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37566 - DNA, 335 bp, Artificial
  Mutation in BnaC.FAD2.b introduced by TALE nuclease pair BnFAD2_T03
caggatccatgggtgcaggtcgaagaatgcaagtctctcctccctccagctcccccggaaccaacaccctcaaacgcgtcccctgcgagacaccaccattcactcggacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37567 - DNA, 335 bp, Artificial
  Mutation in BnaC.FAD2.b introduced by TALE nuclease pair BnFAD2_T03
caggatccatgggtgcaggtggaagaatgaaagtctctcctccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcgtctcctccctctaccacctctccacagcctacttccctctcccttacctcgcctgacccctctactgggcctgccaaggctgcgtcctaacgggcctctgggtcatagccgccgagtgcggccaccacgccttcagcgactac

SEQ ID NO: 37568 - DNA, 337 bp, Artificial
  Mutation in BnaC.FAD2.b introduced by TALE nuclease pair BnFAD2_T03
caggatccatgggcgcaggtggaagaatgcaagtctctcctccctccagctcccccgaaaccaaaaccctcaaacgcgtcccctgcgagacaccacccttcactcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcccagcaggcctctgggtcatagcccacgagtgcggccacctcgccttcagccactac

SEQ ID NO: 37569 - DNA, 336 bp, Artificial
  Mutation in BnaC.FAD2.b introduced by TALE nuclease pair BnFAD2_T03
caggatccatgggtgcaggtgcaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcttggtcatagcccacgagtgcggccaccacgccttcatcgactac

SEQ ID NO: 37570 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccatcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37571 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37572 - DNA, 348 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgatac

SEQ ID NO: 37573 - DNA, 347 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 37574 - DNA, 276 bp, Artificial
  Mutation in BnaC.FAD2.b introduced by TALE nuclease pair BnFAD2_T03
caggatccatgggtgcaggtggaagaatgcaagtctctcctctcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaacgggcctctgggtcatagcccacgagtgcggccaccacgccttcagcgactac

SEQ ID NO: 37575 - DNA, 331 bp, Artificial
  Mutation in BnaC.FAD2.b introduced by TALE nuclease pair BnFAD2_T03
caggatccatgggtgcaggtccaagaatgcaagtctctcctccctccagctcccccggaaccaacaccctcaaacgcgtcccctgcgagacaccaccattcactcttacagcgagcgatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatggcccacgagtgcggccaccacgccttcagcgactac

SEQ ID NO: 37576 - DNA, 281 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccacctcactgcttcaaacgctccatcccacgctccttctcctcttcgacatcatcatctcctcctcgactcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37577 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37578 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37579 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37580 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctcttcgacatcatcatctcctcctcggctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 37581 - DNA, 387 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccaccattcactcttgaccccggagcaggtggtggccatcgccagccacgatggcggcaagcaggcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 37582 - DNA, 336 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccaccattcactctcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37583 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccaagggtgcgtcctaacgggcctctgggtcatcgcccacgaatgcggccaccacgccttcagcgactac

SEQ ID NO: 37584 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37585 - DNA, 352 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtggagaactcaagaaagcaatcccaccgcactgtttcaaacgctcgatccctcgctctttctcctacctcctcttcgacatcctcctttcctcctccctctaccacctctccacagcctacttccctctcctcccccaccctctcccttacctcgcctggcccctctactgggcctgccaaggctgcgtcctaacgggcgtctgggtcatcgcccacgaatgcggccaccacgccttcagcgactac

SEQ ID NO: 37586 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctcttccacctctccacagccttcttccctctcccttacctcgcctgacccctctactgggcctgccaaggctgcgtcctaacgggcctctgggtcatcgcccacgaatgcggccaccacgccttcagcgactac

SEQ ID NO: 37587 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcatcctaacgggcctctgggtcatagcccacgagtgcggccaccacgccttcagcgactac

SEQ ID NO: 37588 - DNA, 321 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctccatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatatcccacgagtgcggccaccacgccttcagcgactac

SEQ ID NO: 37589 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcttcctaacgggcctctgggtcatagcccacgagtgcggccaccacgccttcagcgactac

SEQ ID NO: 37590 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcgcccaccacgccttcagcgactac

SEQ ID NO: 37591 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37592 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccacctcactgcttcaaacgctccatccctcgctccttctcctacctcctcttcgacatcctcgtctcctcctccctctaccacctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37593 - DNA, 347 bp, Artificial
  Mutation in BnaC.FAD2.b introduced by TALE nuclease pair BnFAD2_T03
caggatccatgggtgcaggtgcaagaatgcaagtctatccaccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37594 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccagggctgcgtcctaacgggcctctgggtcatcgcccacgaatgcggccaccacgccttcagcgactac

SEQ ID NO: 37595 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatgctccttaagaaagcaaacccacctcactgcttcaaacgctccatccctcgctccttctcctacctcctcttcgacatcctcgtctcctcctccctctaccacctctccacagcctacttccctctcctccccccccctctcccttacctcgcctggcccctctactgggcctgccaaggctgcgtcctaacgggcctctgggtcatagcccacgagtgcggccaccacgccttcagcgactac

SEQ ID NO: 37596 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 37597 - DNA, 333 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactctcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37598 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccaagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 37599 - DNA, 356 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatcgcccacgaatgcggccaccacgccttcagcgactac

SEQ ID NO: 37600 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 37601 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaagcgcgtcccctgcgagacaccacccttcactaagacctcaagaaagcaatcccacctcacggcttcaaacgctccatccctcgctctttctcctacctcctcttcgacatcctcatatcctcctccctctaccacctctccacagcctacttccctctccccccccaccctctctcttacctcgcctggcccctctactgggcctgccaaggctgcgtcctaacgggcctctgggtcatagcccacgagtgcggccaccacgccttcagcgactac

SEQ ID NO: 37602 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatctcccacgaatgcggccaccacgccttcagcgactac

SEQ ID NO: 37603 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgtgtcctaacgggcctctgggtcatcgcccacgaatgcggccaccacgccttcagcgactac

SEQ ID NO: 37604 - DNA, 337 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37605 - DNA, 319 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 37606 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatccctcgctccttctcctacctcctcttcgacatcatcatctcctcctcgactcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37607 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcgactcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37608 - DNA, 337 bp, Artificial
  Mutation in BnaC.FAD2.b introduced by TALE nuclease pair BnFAD2_T03
caggatccatgggtgcaggtggaagaatgcaagtctctcctccccccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccccctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 37609 - DNA, 414 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaggccgccattgctggagatggccaccacctgctgaggggtcaagccgtgggcctggcacagcaccggcaacagccgagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37610 - DNA, 312 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacctcaagaaagcaatcccacctcactgcttcaaacgctccatcccacgctccttctcctcttccacatcatcatctcctcctcggctcctccctcaccctctctcctacttcgcctggcctctctactgggcctgccaagggtgcgtcctaaccggcgtctgggtcatagcccacgagtgcggccaccacgccttcagcgactac

SEQ ID NO: 37611 - DNA, 370 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcagggtcaagccgtgggcctggcacagcaccggcaacaggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37612 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccacctcactgcttcaaacgctccatccctcgctccttctcctacctcctcttcgacatcctcgtctcctcctccctctaccacctctccacagcctacttccctctcctcccccaccctctcccttgcctcgcctggcccctctacggggcctgccaaggctgcgtcctaacgggcctctgggtcatcgcccacgaatgcggccaccacgccttcagcgactac

SEQ ID NO: 37613 - DNA, 268 bp, Artificial
  Mutation in BnaC.FAD2.b introduced by TALE nuclease pair BnFAD2_T03
caggatccatgggtgcaggtggaagaatgcaagtctctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacttggcctgccaaggctgcgtcctaacgggcctctgggtcatagcccacgagtgcggccaccacgccttcagcgactac

SEQ ID NO: 37614 - DNA, 264 bp, Artificial
  Mutation in BnaC.FAD2.b introduced by TALE nuclease pair BnFAD2_T03
caggatccatgggtgcaggtggaagaatgcaagtctctcctccctccagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37615 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37616 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgctagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgttctaaccggcgtctgggtcatagcccacgagtgcggccaccacgccttcagcgactac

SEQ ID NO: 37617 - DNA, 319 bp, Artificial
  Mutation in BnaC.FAD2.b introduced by TALE nuclease pair BnFAD2_T03
caggatccatgggtgcaggtggatgaatgcaagtctctcctccctccagctcccccgaaaccaaaaccctcaaacgcgtcccctgcgagacaccacccttcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37618 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37619 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 37620 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37621 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttgcctcgcctggcccctctactgggcctgccaaggctgcgtcctaacgggcctctgggtcatcgcccacgaatgcggccaccacgccatcagcgactac

SEQ ID NO: 37622 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 37623 - DNA, 303 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcattcagcgactac

SEQ ID NO: 37624 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37625 - DNA, 332 bp, Artificial
  Mutation in BnaC.FAD2.b introduced by TALE nuclease pair BnFAD2_T03
caggatccatggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 37626 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactttgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37627 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcaatccctcgctctttctcctcttcgacatcatcatctcctcctcggctcctccctctaccacctctccacagcctacttccctctcccttacctcgcctgacccctctactgggcctgccaaggctgcgtcctaacgggcctctgggacatcgcccacgaatgcggccaccacgccttcagcgactac

SEQ ID NO: 37628 - DNA, 371 bp, Artificial
  Mutation in BnaC.FAD2.b introduced by TALE nuclease pair BnFAD2_T03
caggatccatgggtgcaggtggaagaatgcaagtctctcctcccttcagctcccccgaaaacaaaaccctcaaacgcgtcccctgcgagacaccacccttcactctcgccggtgctgtgccaggcccagacctcaagaaagcaatcccacctcactgcttcaaacgctccatccctcgctccttctcctacctcctcttcgacatcctcgtctcctcctccctctaccacctctccacagcctacttccctctcctcccccaccccctcccttgcctcgcctggcccctctactgggcctgccaaggctgcgtcctaacgggcctctgggtcatagcccacgagtgcggccaccacgccatcagcgactac

SEQ ID NO: 37629 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctgagacctcaagaaagcaatcccacctcactgcttcaaacgctccatcccacgctccttctcctctccgacatcatcatctcctcctcggctcctccctctaccacctctccacagcctacttccctctccccccccaccctctcccttacctcgcctggcccctctactgggcctgccaaggctgcgtcctaacgggcctctgggtcatcgcccacgaatgcggccaccacgccttcagcgactac

SEQ ID NO: 37630 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatcccacgctcctacctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 37631 - DNA, 337 bp, Artificial
  Mutation in BnaC.FAD2.b introduced by TALE nuclease pair BnFAD2_T03
caggatccatggggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37632 - DNA, 337 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37633 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccgacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctgacccctctactgggcctgccaaggctgcgtcctagcgggcctctgggtcatagcccacgagtgcggccaccacgccttcagcgactac

SEQ ID NO: 37634 - DNA, 293 bp, Artificial
  Mutation in BnaC.FAD2.b introduced by TALE nuclease pair BnFAD2_T03
caggatccatggtgcaggtggaagaatgcaagtctctcctccctccagctcccccggaaccaacaccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37635 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttctagacctcaagaaagcaatcccacctcactgcttcaaacgctccatcccaccctccttctcctcttcgacatcatcatctcctcctcggctcctccctctaccacctctccacagcctacttccctctcccttacctcgcctgacccctctactgggcctgccaagactgcgtcctaacgggcctctgggtcatagcccacgagtgcggccaccacgccttcagcgactac

SEQ ID NO: 37636 - DNA, 265 bp, Artificial
  Mutation in BnaC.FAD2.b introduced by TALE nuclease pair BnFAD2_T03
caggatccatgggtgcaggtggaagaatgcaagtctctcctccctccagtctctccacctcactgcttcaaacgctccatcccacgctccttctcctcttcgacatcatcatctcctcctcggctcctccctctaccacctctccacagcctacttccctctcccttacctcgcctggcctctctactgggcctgccagggctgcgtcctaaccggcgtctgggtcatagcccacgagtgcggccaccacgccttcagcgactac

SEQ ID NO: 37637 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctcccacctctccccagcctgcttccctctcccttgcctcgcctgacccctctacggggcctgccaaggctgcgtcctaacgggcgtctgggtcatggggggcgagtgcgggcaccaggccttcagcgactac

SEQ ID NO: 37638 - DNA, 293 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaagaaagcaatcccacctcactgcttcaaacgctccatcccacgctccttctccaacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37639 - DNA, 289 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacctcactgcttcaaacgctccatcccacgctccttctcctcttcgacatcatcatctcctcctcggctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 37640 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacaacctacttccctctcccttacctcgcctgacccctctactgggcctgccaaggctgcgtcctaacgggcctctgggtcatagcccacgagtgcggccaccacgccttcagcgactac

SEQ ID NO: 37641 - DNA, 348 bp, Artificial
  Mutation in BnaC.FAD2.b introduced by TALE nuclease pair BnFAD2_T03
caggatccatgggtgcaggtggaagaatgcaagtctatcctccctccagctcccccggaaccaacaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37642 - DNA, 349 bp, Artificial
  Mutation in BnaC.FAD2.b introduced by TALE nuclease pair BnFAD2_T03
caggatccatgggtgcaggtcgaagaatgcaagtctctcctccctccagctcccccgaaaccaaaaccctcaaacgcgtcccctgcgagacaccacccttcactcgaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37643 - DNA, 333 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37644 - DNA, 342 bp, Artificial
  Mutation in BnaC.FAD2.b introduced by TALE nuclease pair BnFAD2_T03
caggatccatgggtgcaggtggaagaatgcaagtctctcctccctccggctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37645 - DNA, 363 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgcggcgggtgtggtggttacgcgcaaagacctcaagaaagcaatcccacctcactgcttcaaacgctccatcccccgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37646 - DNA, 352 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 37647 - DNA, 440 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggggagaaaggcggacaggtatccggtaagcggcagggtcggaacagccgctggaccgtctccagcgcctgcttgccaccattattgctggccctcaagaaagcaatcccacctcactgcttcaaacgctccatcccacgctccttcccctacctccccttcgacatcctcgtctcctcctccctctaccccctctccacagcctacttccctctccgcccccaccctctcccttacctcgcctggcccctctactgggcctgccaaggctgcgtcctaacgggcctctgggtcatcgcccacgaatgcggccaccacgccttcagcgactac

SEQ ID NO: 37648 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttgcctcgcctggcccctctactgggcctgccaaggctgcgtcctaacgggcctctgggtcatcgcccacgaatgcggccaccacgccttcagcgactac

SEQ ID NO: 37649 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 37650 - DNA, 289 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37651 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacacctacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37652 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccccccttcactgtgagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37653 - DNA, 371 bp, Artificial
  Mutation in BnaC.FAD2.b introduced by TALE nuclease pair BnFAD2_T03
caggatccatgggtgcaggtcgaagaatgcaagtctctcctccctccagctcccccggaaccaacaccctcaaacgcgtcccctgcgagacaccaccattcactcggaagagtttgtagaaacgcaaaaaggccatccgtcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37654 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccagggctgcgtcctaacgggcctctgggtcatcgcccacgaatgcggccaccacgccttcagcgactac

SEQ ID NO: 37655 - DNA, 300 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggactgccaaggctgcgtcctaacgggcctctgggtcatagcccacgagtgcggccaccacgccttcagcgactac

SEQ ID NO: 37656 - DNA, 349 bp, Artificial
  Mutation in BnaC.FAD2.b introduced by TALE nuclease pair BnFAD2_T03
caggatccatgggtgcaggtgggagaatgcaagtgtatcctccctccaaaaagtctgaaaccgacaacatcaagcgcgtaccctgcgagacaccgcccttcactgagaactcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 37657 - DNA, 328 bp, Artificial
  Mutation in BnaC.FAD2.b introduced by TALE nuclease pair BnFAD2_T03
caggatccatgggtgcaggtcgaagaatgcaagtctctcctccctccagctcccccggaaccaacaccctcaaacgcgtcccctgcgagacaccaccattcactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37658 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37659 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 37660 - DNA, 375 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtccctgcgagacaccaccattcactctggtggccatcgccagcaatggcggtggcaacagccgctggagacctcaagaaagcaatcccacctcactgcttcaaacgctccatcccacgctccttctcctcttcgacatcatcatctcctcctcggctcctccctctcccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 37661 - DNA, 314 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctcctacttcgcctggcctctctactgggcctgccaagggtgcgtcctaacgggcctctgggtcatagcccacgagtgcggccaccacgccttcagcgactac

SEQ ID NO: 37662 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37663 - DNA, 335 bp, Artificial
  Mutation in BnaC.FAD2.b introduced by TALE nuclease pair BnFAD2_T03
caggatccatgggtgcaggaggaagaatgcaagtctctcctccctccagctcccccggaaccaacacccgcaaacgcgtcccctgcgagacaccaccattcactcagacctcaagaaagcaatcccacctcactgcttcaaacgctccagcccacgctccttctcatcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37664 - DNA, 347 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37665 - DNA, 319 bp, Artificial
  Mutation in BnaC.FAD2.b introduced by TALE nuclease pair BnFAD2_T03
caggatccatgggtgcaggtggaagaatgcaagtgactcccccctccaaaaagtctgaaaccgacaacatcaagcgcgtaccctgcgagacaccgcccttcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaacgggcctctgggtcatcgcccacgaatgcggccaccacgccttcagcgactac

SEQ ID NO: 37666 - DNA, 314 bp, Artificial
  Mutation in BnaC.FAD2.b introduced by TALE nuclease pair BnFAD2_T03
caggatccatgggtgcaggtggaagaatgcaagtctatcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctcccccaccctctctcctacttcgcctggcctctctactgggcctgccagggctgcgtcctaaccggcgtctgggtcatagcccacgagtgcggccaccacgccttcagcgactac

SEQ ID NO: 37667 - DNA, 330 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttgagaactcaagaaagcaatcccaccgcactgtttcaaacgctcgatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37668 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcacacctcactgcttcaaacgctccatccctcgctccttctcctacctcctcttcgacatcctcatctcctcctccctctaccacctctccacaccctacttccctctcctcccccaccctctcccttacctcgcctggcctctctactgggcctgccaaggctgcgtcctaacgggcgtctgggtcatcgcccacgaatgcggccaccacgccttcagcgactac

SEQ ID NO: 37669 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37670 - DNA, 349 bp, Artificial
  Mutation in BnaC.FAD2.b introduced by TALE nuclease pair BnFAD2_T03
caggatccatgggtgcaggtggaagaatgcaagtctctccttcctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctccctttcctcgcctggcccctctactgggcctgccaaggctgcgtcctaacgggcctctgggtcatcgcccacgaatgcggccaccacgccttcagcgactac

SEQ ID NO: 37671 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37672 - DNA, 350 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacacccccaaacgcgtcccctgcgagacaccaccattcactcagacctcaagaaagcaatcccacctcactgcttcaaacgctccatcccacgctccttctcctcttcgacatcatcatctcctcctcgcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 37673 - DNA, 404 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgccagcaataatggtggcaagcaggcgctggagacggtccagcggctgttgccggtgctgagacctcaagaaagcaatcccacctcactgcttcaaacgctccatccctcgctccttctcctacctcctcttcgacatcatcatctcctcctcggctcctccctctcccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37674 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcggcctttttacggttcctctccctcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37675 - DNA, 294 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37676 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37677 - DNA, 317 bp, Artificial
  Mutation in BnaC.FAD2.b introduced by TALE nuclease pair BnFAD2_T03
caggatccatgggtgcaggtggaagaatacaagtctctcctccctccagctcccccggaaccaacaccctcaaacgcgtcccctgccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37678 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccagggctgcgtcctaacgggcctctgggtcatcgcccacgaatgcggccaccacgccttcagcgactac

SEQ ID NO: 37679 - DNA, 346 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccgcgagtgcggccaccacgccttcagcgactac

SEQ ID NO: 37680 - DNA, 421 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgcaccggcaacagccgctggaccgtctccagcgcctgcttgccgccatcgtggctggcgatggccaccacctgaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37681 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcgacctcaagaaagcaatcccacctcactgcttcaaacgctccatcccacgctccttctcctcttcgacatcatcatctcctcctcggctcctccctctaccacctctccacagcctacttccctctcctcccccaccctctctcctacttcgcctggcctctctactgggcctgccagggctgcgtcctaaccggcgtctgggtcatagcccacgagtgcggccaccacgccttcagcgactac

SEQ ID NO: 37682 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacttcgcctggcccctctactggacctgccaaggctgcgtcctaacgggcctctgggtcatcgcccacgaatgcggccaccacgccttcagcgactac

SEQ ID NO: 37683 - DNA, 308 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaagaaagcaatcccacctcactgcttcaaacgctccatccctcgctccttctcctacctcctcttcgacatcatcatctcctcctcggctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 37684 - DNA, 265 bp, Artificial
  Mutation in BnaC.FAD2.b introduced by TALE nuclease pair BnFAD2_T03
caggatccatgggtgcaggtggaagaatgcaagtctctcctccctccagtctctccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacggacctctgggtcatagcccacgagtgcggccaccacgccttcagcgactac

SEQ ID NO: 37685 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagaaaccacccttcactcgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37686 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 37687 - DNA, 335 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagactccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37688 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37689 - DNA, 356 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccacctcactgcttcaaacgctccatccctcgctccttctcctacctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37690 - DNA, 363 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgcgatggcggcaagcaggcgctggagaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactcc

SEQ ID NO: 37691 - DNA, 336 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctaaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgagtgcggccaccacgccttcagcgactac

SEQ ID NO: 37692 - DNA, 342 bp, Artificial
  Mutation in BnaC.FAD2.b introduced by TALE nuclease pair BnFAD2_T03
caggatccatgggtgcaggtggaataatgcaagtctctcctccctccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37693 - DNA, 353 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgagacctcaagaaagcaatcccacctcactgcttcaaacgctccatccctcgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37694 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 37695 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctcctgggcctgccaaggctgcgtcctaacgggcctctgggtcatagcccacgagtgcggccaccacgccttcagcgactac

SEQ ID NO: 37696 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37697 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37698 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37699 - DNA, 393 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggtggtggccatcgccagcaatattggtggcaagcaggcgctgagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37700 - DNA, 324 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 37701 - DNA, 266 bp, Artificial
  Mutation in BnaC.FAD2.b introduced by TALE nuclease pair BnFAD2_T03
caggatccatgggtgcaggtggaagaatgcaagtctcgacctcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37702 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccgccacgccttcagcgactac

SEQ ID NO: 37703 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccataaaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 37704 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttcctcaagaaagcaatcccacctcactgcttcaaacgctccatcccacactccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37705 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 37706 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgacctcaagaaagcaatcccacctcactgcttcaaacgctccatcccacgctccttctcctcttcgacatcatcatctcctcctcggctcctccctctaccacctctccacagcctacttccctctcccttacctagcctgacccctctactgggcctgccaaggctgcgtcctaacgggcgtctgggtcatagcccacgagtgcggccaccacgccttcagcgactac

SEQ ID NO: 37707 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37708 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 37709 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaaccggcgtctgggtcatagcccacgagtgcggccaccacgccttcagcgactac

SEQ ID NO: 37710 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgaacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 37711 - DNA, 475 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctataaggcttgatgaaacaacgcggcgagccccatgaccaaaatcccttaacgtgagttacgctctgtgccaggcccacggcttgaccccggagcaggtggtggccatcgccagccacgatggcggcaagcagagacctcaagaaaccaatcccccctcactgcttcaaacgccccatcccccgctcctcctcctacctcctcttcgacaccctcgcctcctcctcggctcctccctctaccacctctccacagcctacttccctctcccttacctcgcctgacccctctactgggcctgccaaggctgcgtcctaacgggcctctgggtcatcgcccatgaatgcggccaccacgccttcagcgactac

SEQ ID NO: 37712 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37713 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactgacctcaagaaagcaatcgcacctcactgctccaaacgctccatccctcgctccttctcctacctcctcttcgacatcctcgtctcctcctccctctaccacctctccacagcctacttccctctccccccccaccctctcccttacctcgcctggcccctctactgggcctgccaaggctgcgtcctaacgggcctctgggtcatcacccacgaatgcggccaccacgccttcagcgactac

SEQ ID NO: 37714 - DNA, 257 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37715 - DNA, 349 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaccatcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 37716 - DNA, 388 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcttgctggcgatggccaccacctgctggggggtcaagccgtgggcctggcacagcaccggcaacagccgcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37717 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37718 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctatccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37719 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctctgagacctcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctaccaaggctgcgtcctaacgggcctctgggtcatagcccacgagtgcggccaccacgccttcagcgactac

SEQ ID NO: 37720 - DNA, 340 bp, Artificial
  Mutation in BnaC.FAD2.b introduced by TALE nuclease pair BnFAD2_T03
caggatcgatgggtgcaggtggaagaatgcaagtgtctcctccctccaagaagtctgaaaccgacaccatcaagcgcgtaccctgcgagacaccaccattcactctcgggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37721 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacatcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37722 - DNA, 481 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactctcgctgcgcgtaactggcacagcaccggcaacagccgctggaccgtctccagcgcctgcttgccaccgccattgctggcgatggccaccacctgctggggggtcaagccgtgggcctggcacagcaccggcaacagccgctggaccagacctcaagaaagcaatcccacctcactgcttcaaacgctccatcccacgctccttctcctctgcgacatcatcatctcctcctcggctcctccctctaccacctctccacagcctacttccctctcccttacctcgcctgacccctctaccgggcctgccaaggctgcgtcctaacgggcctctgggtcatagcccacgagtgcggccaccacgccttcagcgactac

SEQ ID NO: 37723 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcaggcgactac

SEQ ID NO: 37724 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcacacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37725 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcacctggcccctctactgggcctgccaaggctgcgtcctaacgggcctctgggtcatcgcccacgaatgcggccaccacgccttcagcgactac

SEQ ID NO: 37726 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcccaacgggcctctgggtcatagcccacgagtgcggccaccacgccttcagcgactac

SEQ ID NO: 37727 - DNA, 303 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacctcactgcttcaaacgctccatctcacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37728 - DNA, 393 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggtggtggccatcgccagcaatattggtggcaagcaggcgctgagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 37729 - DNA, 345 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctcggggtcatcgcccacgaatgcggccaccacgccttcagcgactac

SEQ ID NO: 37730 - DNA, 305 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcccctgggtcatcgcccacgaatgcggccaccacgccttcagcgactac

SEQ ID NO: 37731 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacttgagacctcaagaaagcaatcccacctcactgcttcaaacgctccatccctcgctccttctcctacctcctcttcgacatcctcgtctcctcctccctctgccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37732 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37733 - DNA, 317 bp, Artificial
  Mutation in BnaC.FAD2.b introduced by TALE nuclease pair BnFAD2_T03
caggatccatgggtgcaggtagaagaatgcaagtctctcctccctccagctcccccggaaccaacaccctcaaacgcgtcccctgcgagacctcaagaaagcaattccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 37734 - DNA, 362 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaatggcggtggcaagcaggcgctggagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37735 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37736 - DNA, 369 bp, Artificial
  Mutation in BnaC.FAD2.b introduced by TALE nuclease pair BnFAD2_T03
caggatccatgggtgcaggtggaagaatgcaagtctcacctccctccagctcccccggaaccaacaccctcaaacggtccagcggctgttgccggtgctgtgccaggcccacggcttgaccccggagcaggtggtggccagacctcaagaaagcaatcccacctcactgcttcaaacgctccatcccacgctccttctcctcttcgacatcatcatctcctcctcggctcctccctctaccacctctccacagcctacttccctctcccttccctcgcctggcccctctacggggccggccaaggctgcgtcctaacgggcctctgggtcatagcccacgagtgcggccaccacgccttcagcgactac

SEQ ID NO: 37737 - DNA, 343 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37738 - DNA, 333 bp, Artificial
  Mutation in BnaC.FAD2.b introduced by TALE nuclease pair BnFAD2_T03
caggatccatgggtgcaggtgcaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctcttcgacatcatcatctcctcctcgactcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37739 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagaaagcaatcccacctcactgcttcaaacgctccatccctcgctccttctcctacctcctcttcgacatcctcttctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37740 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37741 - DNA, 308 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37742 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 37743 - DNA, 335 bp, Artificial
  Mutation in BnaC.FAD2.b introduced by TALE nuclease pair BnFAD2_T03
caggatccacgggtgcaggtggaagaatgcaagtctctcctcccttcagctcccccgaaaccaaaaccctcaaccgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37744 - DNA, 292 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37745 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggccggccaaggctgcgtcctaacgggcctctgggtcatagcccacgagtgcggccaccacgccttcagcgactac

SEQ ID NO: 37746 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37747 - DNA, 335 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37748 - DNA, 379 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggggggtcaagccgtgggcctggcacagcaccggcaacagccgcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37749 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccatcagcgactac

SEQ ID NO: 37750 - DNA, 448 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacccccagcaggtggtggccatcgccagcaataatggtggcaagcaggcgctggagacggtccagcggctgttgccggtgctcagaccccgtagaaaagatcaaaggatctagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37751 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37752 - DNA, 280 bp, Artificial
  Mutation in BnaC.FAD2.b introduced by TALE nuclease pair BnFAD2_T03
caggatccatgggtgcaggtggaagaatgcaagtctcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37753 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37754 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37755 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37756 - DNA, 334 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactctccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaatgctgcgtcctaacgggcctctgggtcatagcccacgagtgcggccaccacgccttcagcgactac

SEQ ID NO: 37757 - DNA, 327 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccagggctgcgtcctaaccggcgtctgggtcatagcccacgaatgcggccaccacgccttcagcgactac

SEQ ID NO: 37758 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaacaaaaccctcaaacgcgtcccctgcgagacaccaccattaactagacctcaagaaagcaatcccacctcactgcttcaaacgctccatcccacgctccttctcctcttcgccatcatcatctcctcctcggctcctccctctaccaccactccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37759 - DNA, 394 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccagaacgggtagtgaattgcgcttgagatggtttaatttcaactttaatcattattgaattccctcgggtttcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37760 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccgcgaatgcggccaccacgccttcagcgactac

SEQ ID NO: 37761 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 37762 - DNA, 295 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37763 - DNA, 358 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatccctcgctccttctcctacctcctcttcgacatcctcgtctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37764 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccgcgccttcagcgactac

SEQ ID NO: 37765 - DNA, 328 bp, Artificial
  Mutation in BnaC.FAD2.b introduced by TALE nuclease pair BnFAD2_T03
caggatccatgggtgcaggtggaagaatgcaagtctctcctccctccagctccccccaaaccaaaaccctcaaacgcgtcccctgcgagacaccacccttcactctagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtcctaacgggcctctgggtcatagcccacgagtgcggccaccacgccttcagcgactac

SEQ ID NO: 37766 - DNA, 347 bp, Artificial
  Mutation in BnaC.FAD2.b introduced by TALE nuclease pair BnFAD2_T03
caggatccatgggtgcaggtggaagaatgcaagtctatcctccctcccgctcccccggaaccaacaccctcaaacgcgtcccctgcgagacaccaccattcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37767 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37768 - DNA, 353 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccggagacctcaagaaaacaatcccaccgcactgtttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37769 - DNA, 257 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 37770 - DNA, 265 bp, Artificial
  Mutation in BnaC.FAD2.b introduced by TALE nuclease pair BnFAD2_T03
caggatccatgggtgcaggtggaagaatgcaagtctctcctccctccagtctctccacctcactgcttcaaacgctccatcccacgccccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37771 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctcgatccctcgctctttctcctacctcatctgggacatcatcatagcctcctgcttctactacgtcgccaccacttacttccctctcccttacctcgcctgacccctctactgggcctgccaaggctgcgtcctaacgggcctctgggtcatcgcccacgagtgcggccaccacgccttcagcgactac

SEQ ID NO: 37772 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcctcaagaaagcaatcccacctcactgcttcaaccgctccatcccaccctcctcctcctcttcgacatcatcatctcctcctcggctcctccctctcccacctcccccccgcctccttccctctcccttacctcgcctggcccctctactgggcctgccaaggctgcgtcctaacgggcctctgggtcatagcccacgagtgcggccaccacgccttcagcgactac

SEQ ID NO: 37773 - DNA, 337 bp, Artificial
  Mutation in BnaC.FAD2.b introduced by TALE nuclease pair BnFAD2_T03
caggatccatgggtgcaggtggaagaatgcaagtgtctcctccctccaaaaagcctgaaaccgacaacatcaagcgcgtaccctgcgagacaccgcccttcactgtaagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37774 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaacctcaaacgcgtcccctgcgagacacacctcaagaaagcaatcccacctcactgcttcaaacgctccatccctcgctccttctcctacctcctcttcgacatcttcctcgcctcctccctctaccacctctccacagcctacttccctctccccccccaccctctcccgtacctcgcctcgcccctctactgggcctgccagggctgcgtcctaacgggcctctgggtcatcgcccacgaatgcggccaccacgccttcagcgactac

SEQ ID NO: 37775 - DNA, 349 bp, Artificial
  Mutation in BnaC.FAD2.b introduced by TALE nuclease pair BnFAD2_T03
caggatccatgggtgcaggtggaacaatgcaagtgtctcctccctccaagaagtctgaaaccgacaccatcaagcgcgtaccctgcgagacaccgcccttcactgtatcatcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37776 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccacaccctctcccttacctcgcctggcccctctactgggcctgccaaggctgcgtcctaacgggcctctgggtcatcgcccacgaatgcggccaccacgccttcagcgactac

SEQ ID NO: 37777 - DNA, 332 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccgaaaccatcaagcgcgtaccctgcgagacaccacccttcactctcccaccgcactatttcaaactctccatccctcgctccttcacctacctccccttcgacatcctcatcccctcctccctctaccacctctccaccgcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37778 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccaagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37779 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactaagacctcaagaaagcaatcccacctcactgcttcaaacgctccatccctcgctccttctcctacctcctcttcgacatcctcgtctcctcctccctctaccacctctccacagcctacttccctctcctaccccaccctctcccttacctcgcctggcccctctactgggcctgccaaggctgcgtcctaacgggcctctgggtcatcgcccacgaatgcggccaccacgccttcagcgactac

SEQ ID NO: 37780 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 37781 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccgcctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37782 - DNA, 340 bp, Artificial
  Mutation in BnaC.FAD2.b introduced by TALE nuclease pair BnFAD2_T03
caggatccatgggtgcaggtggaagaatgcaagtctatcctccctccagctcccccggaaccaacaccctcaaacgcgtcccctgcgcgacaccaccattcactctttagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctcacgggcctctgggtcatcgcccacgaatgcggccaccacgccttcagcgactac

SEQ ID NO: 37783 - DNA, 433 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctccccccagcaggtggtggccatcgccagcaatggcggtggcaagcaggcgctggagacggtccagcggctgttgccggggctgtgccaggagacctcaagaaagcaatcccacctcactgcttcaaacgctccatccctcgctcctcctcctccctcctcttcgacaccatcacctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 37784 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37785 - DNA, 308 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggagacctcaagaaagcaatcccacctcactgcttcaaacgctccatcccacgctccttctcctcttcgacatcctcgtctcctcctccctcaccctctctcctacttcgcctggcctctctactgggcctgccagggctgcgtcctaaccggcgtctgggtcatagcccacgagtgcggccaccacgccttcagcgactac

SEQ ID NO: 37786 - DNA, 355 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttttggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37787 - DNA, 426 bp, Artificial
  Mutation in BnaC.FAD2.b introduced by TALE nuclease pair BnFAD2_T03
caggatccatgggtgcaggtggaagaatgcaagtctctcatccctccagctcccccggaaccaacaccctcaaacgcgtcccctgcgagacaccaccattcactctccccccagcaggtggtggccatcgccagcaatggcggtggcaagcaggcgctggagacggtccagcggctgttgccggtgctgtgccaggcgaccccaagaaagcaatcccacctcactgcttcaaacgctccatcccacgctccttctcctcttcgacatcatcagctcctcctcggctcctccctctaccacctctccacagcctcctaccctctcccttacctcgcctgacccctctactgggcctgccaaggctgcgtccgaacgggcctctgggtcatcgcccgcgaatgcggccaccacgccttcagcgactac

SEQ ID NO: 37788 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgtgtcatcgcccacgaatgcggccaccacgccttcagcgactac

SEQ ID NO: 37789 - DNA, 349 bp, Artificial
  Mutation in BnaC.FAD2.b introduced by TALE nuclease pair BnFAD2_T03
caggatccatgggtgcaggtggaagaatgcaagtctatcctccctccagctcccccgaaacccaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttgcctcaccaggcccctctactgggcctgccaaagctgcgtcctaacgggcctcgaggtcatcgcccacgagtgcggcctccacgccttcagcaactac

SEQ ID NO: 37790 - DNA, 372 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcgggtggggtggttacgtagacctcaaaaaagcaatcccccctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37791 - DNA, 311 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtatagaactcaagaaagcaatcccacctcagtgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37792 - DNA, 410 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcagaggatttgtcctactcaggagagcgttcaccgacaaacaacagataacacgaaaggcccagtcttccctcaagaaagcaatcccacctcactgcttcaaacgctccatcccacgctccttctcctacctcctcttcgacatcctcgtctccccctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37793 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaaggctgcgtcctaacgggcctctgggtcatcgcccacgaatgcggccaccacgccttcagcgactac

SEQ ID NO: 37794 - DNA, 336 bp, Artificial
  Mutation in BnaC.FAD2.b introduced by TALE nuclease pair BnFAD2_T03
caggatccatgggtgcagggggaagaatgcaagtctctcctccatacagctcccccgaaaccaacaccctcaaacgcgtcccctgcgggacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagccctcgagtgcggccaccgcgccttcagcgactcc

SEQ ID NO: 37795 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 37796 - DNA, 325 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaagacctcaagaaagcaatcccacctcactgcttcaaacgctccatccctcgctccttctcctcttcgacatcatcatctcctcctcgcctcctccctctaccacctctccacagccttcttccctctcccttacctcgcctgacccctctactgggcctgacaaggatgagtcctaacaggcgtctgggtcatagcccgcgagtgaggccaccacgccatcagcgactac

SEQ ID NO: 37797 - DNA, 275 bp, Artificial
  Mutation in BnaC.FAD2.b introduced by TALE nuclease pair BnFAD2_T03
caggatccatgggtgcaggtggaagaatgcaagtctctcctctcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcacgactac

SEQ ID NO: 37798 - DNA, 396 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagttgccggtgctgtgccaggcccacggcttgaccccccagcaggtggtggccatcgccagcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37799 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37800 - DNA, 295 bp, Artificial
  Mutation in BnaC.FAD2.b introduced by TALE nuclease pair BnFAD2_T03
caggatccatgggtgcaggtggaagaatgcaagtctctcatccctccaggtagacctcaagaaagcaatcccacctcactgcttcaaacgctccatccctcgctccttctcctacctcctcttcgacatcctcgtctcctcctccctctaccacctctccacagcctacttccctctcctccctcagcctctcccttacctcgcctggcctctctactgggcctgccagggctgcgtcctaacgggcctctgggtcatagcccacgagtgcggccaccacgccttcagcgactac

SEQ ID NO: 37801 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgagtgcggccaccacgccttcagcgactac

SEQ ID NO: 37802 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctaaacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 37803 - DNA, 336 bp, Artificial
  Mutation in BnaC.FAD2.b introduced by TALE nuclease pair BnFAD2_T03
caggatccatgggtgcaggtggaagaatgcaagtctatcctccctccagctcccccggaaccaaaaccctcaaacgcgtcccctgcgagacaccacccttcactctcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37804 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacagggcctgccaaggctgcgtccgaacgggcctctgggtcatagcccacgagtgcggccaccacgccttcagcgactac

SEQ ID NO: 37805 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 37806 - DNA, 380 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgccggtgctgtgccaggcccacggcttgaccccccagcaggtggtgggaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37807 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 37808 - DNA, 348 bp, Artificial
  Mutation in BnaC.FAD2.b introduced by TALE nuclease pair BnFAD2_T03
caggatccatgggtgcaggtggaagaatgcaagtgtctcctccctcccagaagtctgaaaccgacaccatcaagcgcgtaccctgcgagacaccgcccttcactggaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggccggccaaggctgcgtcctaacgggcctctgggtcatatcccacgagtgcggccaccacgccatcagcgactac

SEQ ID NO: 37809 - DNA, 345 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacagggccggccaaggctgcgtcctaacgggcctctgggtcatcgcccacgaatgcggccaccacgccttcagcgactac

SEQ ID NO: 37810 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggagacctcaagaaagcaatcccacctcactgcttcaaacgctccatcccacgctccttctcctcttcgacatcatcatctcctcctcggctcctccctctaccacctctccacagcctacttccctctccctgacctcgcctgacccctctactgggcctgccaaggctgcgtcctaacgggcctctgggtcatagcccacgagtgcggccaccacgccttcagcgactac

SEQ ID NO: 37811 - DNA, 349 bp, Artificial
  Mutation in BnaC.FAD2.b introduced by TALE nuclease pair BnFAD2_T03
caggatccatgggtgcaggttgaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37812 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 37813 - DNA, 407 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttcttcctggctagcggtacgcgtattaattgcgttgcgctcactgcccgctttccagagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctcgcctggcctctctactgggcctgccaagggtgcgtcctaacgggcctctgggtcatagccctcgagtgcggccaccacgccttcagcgactac

SEQ ID NO: 37814 - DNA, 301 bp, Artificial
  Mutation in BnaC.FAD2.b introduced by TALE nuclease pair BnFAD2_T03
caggatccatgggtgcaggtggaagaatgcaagtctatcctccctcccgtccccccggaaacaacaccctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37815 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtcctaacgggcctctgggtcatcgcccacgaatgcggccaccacgccttcagcgactac

SEQ ID NO: 37816 - DNA, 337 bp, Artificial
  Mutation in BnaC.FAD2.b introduced by TALE nuclease pair BnFAD2_T03
caggatccatgggtgcaggtggaagaatgcaagtctctcctcccttcagctcccccggaaccaacaccctcaaacgcgtcccctgcgagacaccaccattcactctcagacctcaagaaagcaatcccacctcactgcttcaaacgctccattccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37817 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactcaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaagggtgcgtcctaaccggcgtctgggtcatagcccacgagtgcggccaccacgccttcagcgactac

SEQ ID NO: 37818 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcacctcaagaaagcaatcccacctcactgcttcaaacgctccatccctcgctccttctcctacctcctcttcaacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37819 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccacctcactgcttcaaacgctccatccctcgctccttctcctcttcgacatcatcatctcctcctcggctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 37820 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctccttcgcctggcccctctactgggcctgccaaggctgcgtcctaacgggcctctgggtcatcgcccacgaatgcggccaccacgccttcagcgactac

SEQ ID NO: 37821 - DNA, 304 bp, Artificial
  Mutation in BnaC.FAD2.b introduced by TALE nuclease pair BnFAD2_T03
caggatccatgggtgcaggtggaagaatgcaagtgtctcctccctccaaaaagcctgaaaccgacaacatcaagcgcgtcccctgcgagacaccacccttcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37822 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 37823 - DNA, 288 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagccctcgagtgcggccaccacgccttcagcgactac

SEQ ID NO: 37824 - DNA, 343 bp, Artificial
  Mutation in BnaC.FAD2.b introduced by TALE nuclease pair BnFAD2_T03
caggatccatgggtgcaggtggaagaatgcaagtctctcctccctccagctccccggaaccaacaccctcaaacgcgtcccctgcgagacaccaccatagacctcaagaaaacaatcccacctcactgcttcaaacgctccctcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37825 - DNA, 335 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactcaagaaagcaatcccaccgcactgcttcaaacgctccatccctcgctccttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37826 - DNA, 301 bp, Artificial
  Mutation in BnaC.FAD2.b introduced by TALE nuclease pair BnFAD2_T03
caggatccatgggtgcaggtggaagaatgcaagtctctcctccctcccgtccccccggaaacaacaccctcagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgagtgcggccaccacgccttcagcgactac

SEQ ID NO: 37827 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaaaaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccacggctgcgtcctaacgggcctctgggtcatagcccacgagtgcggccaccacgccttcagcgactac

SEQ ID NO: 37828 - DNA, 349 bp, Artificial
  Mutation in BnaC.FAD2.b introduced by TALE nuclease pair BnFAD2_T03
caggatccatgggtgcaggtgtaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37829 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37830 - DNA, 358 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaggtcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37831 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgccccttctcctcttcgacctcatcatctcctcctcggctcctccctctaccacccctccacagcctacttccctctcctcccccaccctctcccttacctcgcctggcccctctaccgggcctgccaaggctgcgtcctaacgggcctctgggtcatcgcccacgaatgcggccaccacgccttcagcgactac

SEQ ID NO: 37832 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 37833 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctctccgacatcctcgtctcctcctccctctaccacctctccccagcctacttccctctcctcccccaccctctcccttccctcgcccggcccctctactgggcctgccaaggctgcgtcctaacgggcctctgggtcatcgcccacgagtgcggccaccacgccttcagcgactac

SEQ ID NO: 37834 - DNA, 403 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtctccagcggctgttgccgccatcgtggctgtcgatggccaccacctgctccggagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37835 - DNA, 335 bp, Artificial
  Mutation in BnaC.FAD2.b introduced by TALE nuclease pair BnFAD2_T03
caggatccatgggtgcaggtggaagaatgcaagtctctcctccctccagctccccagaaaccaaaaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37836 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37837 - DNA, 365 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggctcttgatccggcaaaaaaaccaccgctacctcaagaaagcaatcccacctcactgcttcaaacgctccatcccacgctccttctcctcttcgacatcatcatctcctcctcggctcctccctctaccacctctccacagcctacttccctctcccttacctcgcctgccccctctgctgtgcctgccaagcctgcgtcctaactggcctctgtgtcatagcccacgagtgcggccaccacgccttcagcgactac

SEQ ID NO: 37838 - DNA, 372 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagcggctgttgccggtgctgtgccaggcccccgctcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 37839 - DNA, 339 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 37840 - DNA, 358 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctggcggcaagcaggcgctggaggagacctcaagaaagcaatcccacctcactgcttcaaacgctccatcccacgctccttctcctcttcgacatcatcatctcctcctcggctcctccccctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37841 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactctccatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37842 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacagacctcaagaaagcaatcccacctcactgcttcaaacgctccatccctcgctccttctcctacctcctcttcgacatcctcgtctcctcctccctctaccaccactccaccgcctacttccctctcctcccccaccctctcccttacctcgcctggcccctctactgggcctgccaaggctgcgtcctaacgggcctctgggtcatcgcccgcgaatgcggccaccacgccttcagcgactac

SEQ ID NO: 37843 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgccagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 37844 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacttggcctgccaaggctgcgtcctaacgggcctctgggtcatagcccacgagtgcggccaccacgccttcagcgactac

SEQ ID NO: 37845 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37846 - DNA, 413 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggatgggatccgatccaatgaagacaatcgacatagtgactggatatgttgtgttttacagagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37847 - DNA, 317 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37848 - DNA, 319 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37849 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaagggtgcgtcctaacgggcctctgggtcatagcccacgagtgcggccaccacgccttcagcgactac

SEQ ID NO: 37850 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 37851 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcacctcaagaaagcaatcccacctcactgcttcaaacgctccatccctcgctccttctcctcttcgccatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37852 - DNA, 305 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37853 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37854 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 37855 - DNA, 419 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttggggggtcaagccgtgggcctggcacagcaccggcaacagccgctggaccgtctccagcgcctgcttgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggtctgccaaggctgcgtcctaacgggcctctgggtcatcgcccacgaatgcggccaccacgccttcagcgactac

SEQ ID NO: 37856 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacgagacctcaagaaagcaatcccacctcactgcttcaaacgctccatccctcgctccttctcctacctcctcttcgacatcctcgtctcctcctccctctaccacctctccacagcctacttccctctactcccccaccctctcccttacctcgcctggcccctctactgggcctgccaaggctgcgtcctaacgggcctctgggtcatcgcccacgaatgcggccaccacgccttcagcgactac

SEQ ID NO: 37857 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37858 - DNA, 273 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaaccggcgtctgggtcatcgcccacgaatgcggccaccacgccttcagcgactac

SEQ ID NO: 37859 - DNA, 420 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggaccgtctccagcgcctgcttgccaccgccattgctggcgatggccaccacctgctggggggtcaagccgtgggcctggcggagacctcaagaaagcaatcccacctcactgcttcaaacgctccatcccacgctccttctcctctccgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37860 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactaacctcaagaaagcaatcccacctcactgcttcaaacgctccatcccacgctccttctcctcttcgacatcatcatctcctcctcggctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 37861 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgctagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 37862 - DNA, 409 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgactacggcgtgatcgtggacaccacgagcatcacaaaaatcgacgctcaagtcagaggtggcgaaacccggagacctcaagaaagcaatcccacctcactgcttcaaacgctccatcccacgctccttctcctcttcgacatcatcatctcctcctcggctcctccctcttccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 37863 - DNA, 308 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 37864 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37865 - DNA, 347 bp, Artificial
  Mutation in BnaC.FAD2.b introduced by TALE nuclease pair BnFAD2_T03
caggatccatgggtgcaggtggaagaatgcaagtgtctcctccctccagctcgcccggaaccaacaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37866 - DNA, 302 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcccccacccgctcccttacctcgcctggcccctctactgggcctgccagggctgcgtcctaaccggcgtctgggtcatagcccacgagtgcggccaccacgccttcagcgactac

SEQ ID NO: 37867 - DNA, 350 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttgcctcgcctggcccctctactgggcctgccaaggctgcgtcctaacgggcctctgggtcatagcccacgagtgcggccaccacgccttcagcgactac

SEQ ID NO: 37868 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcaggcgctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37869 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcaggcgactac

SEQ ID NO: 37870 - DNA, 300 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaagaaagcaatcccacctcactgctgcaaacgctccatccctccctccttctcctacctcctcttcgacatccccgtctcctcctccctctaccacctcgccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 37871 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 37872 - DNA, 335 bp, Artificial
  Mutation in BnaC.FAD2.b introduced by TALE nuclease pair BnFAD2_T03
caggatccatgggtgcaggtgcaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37873 - DNA, 376 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccaccattcactcaatggcggtggcaagcaggcgctggagagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 37874 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactcaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37875 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcccttacctcgcctggcctctctactgggcctgccaagggtgcgtcctaccggcgtctgggtcatagcccacgagtgcggccaccacgccttcagcgactac

SEQ ID NO: 37876 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacacctcaagaaagcaatcccacctcactgcttcaaacgctccatcccacgctccttctcctcttcgacatcatcatctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37877 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcatcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37878 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 37879 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgaaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37880 - DNA, 335 bp, Artificial
  Mutation in BnaC.FAD2.b introduced by TALE nuclease pair BnFAD2_T03
caggatccatgggtgcaggtggaagaatgcaagtctcacctccctccagctcccccgaaaccaaaaccctcaaacgcgtcccctgcgagacaccacccttcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctcgactgggcctgccaaggctgcgtcctaacgggcctctgggtcatagcccacgagtgcggccaccacgccttcagcgactac

SEQ ID NO: 37881 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37882 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37883 - DNA, 423 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggactgggcctttcgttttatctgttgtttgtcggtgaacgctctcctgagtaggacaaatccgccgggagcggatttgaacgtggagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37884 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37885 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccgccctctcccttacctcgcctggcccctctactgggcctgccaaggctgcgtcctaacgggcctctgggtcatcgcccacgaatgcggccaccacgccttcagcgactac

SEQ ID NO: 37886 - DNA, 474 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcgggtcaagccgtgggcctggcacagcaccggcaacagcgcctgcaccgtctccagcgcctgcttgccaccaatattgctggcgatggccaccacctgctccggggtcaagccgtgggcctggcacagcaccggcaacagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 37887 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacggagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37888 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccaccattcactcgacctcaagaaagcaatcccacctcactgcttcaaacgctccatcccaccctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 37889 - DNA, 337 bp, Artificial
  Mutation in BnaC.FAD2.b introduced by TALE nuclease pair BnFAD2_T03
caggatccatgggtgcaggtggaagaatgcaagtctctcccccctccagctcccccggaaccaacaccctcaaacgcgtcccctgcgagacaccacccttcactctcagaccccaagaaaacactcccccctcactccttcacacgccccctcccccgctcctcctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37890 - DNA, 334 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactagaactcaagaaagcaatcccacctcactgcttcaaccgctccatcccacgctccttctcctcttcgacatcatcatctcctcctcggctcatccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37891 - DNA, 343 bp, Artificial
  Mutation in BnaC.FAD2.b introduced by TALE nuclease pair BnFAD2_T03
caggatccatgggtgcaggtggaagaatgcaagtctctcctcccttcagctcccccgaaaccaaaaccctcaaacgcgtcccctgcgagacaccaccattcaactcaagaaagcaatcccaccgcactgtttcaaacgctcgatccctcgctccttctcctacctcctcttcgccatcctcgtctcctcctccctctaccacctctccacagcctacttccctctcctcccccaccctctcccttacctcgcctggcccctctactgggcctgccaaggctgcgtcctcacgggcctctgggtcatagcccacgagtgcggccaccacgccttcagcgactac

SEQ ID NO: 37892 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccacctcactgcttcaaacgctccatcccacgctccttctcctcttcgacatcatcatctcctcctcggctcctccctctaccacctctccacagcctacttccctctcctcccccatcctctcccttacctcgcctggcccctctactgggcctgccaaggctgcgtcctaacgggcctctgggtcatcgcccacgaatgcggccaccacgccttcagcgactac

SEQ ID NO: 37893 - DNA, 409 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtcccctgcgagacaccaccattgagcggatttgtcctactcaggagagcgttcaccgacaaacaacagataacacgaaaggcccagtcttccctcaagaaagcaatcccacctcactgcttcaaacgctccatccctcgctccttctcctacctcctcttcgacatcctcgtctcctcctccctctcccccctctccacagcctacttccctctccccccccaccctctcccttcccccgcctggcccctctactgggcctgccaaggctgcgtcctaacgggcctctgggtcatcgcccacgaatgcggccaccacgcctcagcgactac

SEQ ID NO: 37894 - DNA, 322 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaaacgcgtcccctgttatcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37895 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 37896 - DNA, 372 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagactccacccttcactctcagcggctgttgccgtcgctgtgccaggcccccgctcaatcccacctcacttcttcaaacgctccatccctctctccttctcctacctcctcttcgacatcctcgtctcctcctccctctaccacctctccacagcctacttccctctcctcccccaccctctcccttacctcgcctggcccctctactgggcgtgccaaggctgcgtcctaacgggcctctgggtcatcgcccacgaatgcggccaccacgccatcagcgactac

SEQ ID NO: 37897 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctacagggcctgccaaggctgcgtcctaacgggcctctgggtcatcgcccacgaatgcggccaccacgccttcagcgactac

SEQ ID NO: 37898 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgagtgcggccaccacgccttcagcgactac

SEQ ID NO: 37899 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgagtgcggccaccacgccttcagcgactac

SEQ ID NO: 37900 - DNA, 425 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgctttccagtcgggaaacctgtcgtgccagctgcattaatgaatcggccaacgcgcggggagaggcggtttgcgtgaacccaagaaagaaatcccaccgcactgttttaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37901 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttccctcgcctgacccctctactgggcctgccaaggctgcgtcctaacgggcctctgggtcatcgcccacgaatgcggccaccacgccttcagcgactac

SEQ ID NO: 37902 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatccctcgctccttttcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 37903 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactctaaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 37904 - DNA, 345 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 37905 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaagggtgcgtcctaaccggcgtctgggtcatagcccacgagtgcggccaccacgccttcagcgactac

SEQ ID NO: 37906 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 37907 - DNA, 330 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccaccctggcgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37908 - DNA, 439 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgcgagacaccacccttcactgagcgcctgcttgccaccgccattgctggcgatggccaccacctgctccggggtcaagccgtgggcctggcacagcaccggcaacagccgctgacctcaagaaagcaatcccacctcactgcttcaaacgctccatccctcgctccttcccctacctcccctccgacatcctcgtcccctcctccctctaccacctccccacagcctacttccctctcccccccccccctctcccttccctcgcctggcccctctactgggcctgccaaggctgcgtcctaacgggcctctgggtcatagcccacgagtgcggccaccacgccttcagcgactac

SEQ ID NO: 37909 - DNA, 370 bp, Artificial
  Mutation in BnaC.FAD2.b introduced by TALE nuclease pair BnFAD2_T03
caggatccatgggtgcaggtggaagaatgcaagtctctcctccctccagctcccccggaactaacaccctcaaacgcgtcccctgcgagacaccaccattcactctcggtggataaccgtattaccgcctttgagtgagctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37910 - DNA, 400 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcccacggcttgaccccccagcaggtggtggccatcgccagcaatgcagacctcaagaaagcaatcccacctcactgcttcaaacgctccatcccacgctccttctcctcttcgccatcatcatctcctcctcggctcctccctctaccacctctccacagcctacttccctctcctcccccaccctctcccttccctcgcctggcccctctacagggcctgccaaggctgcgtcctaacgggcctctgggtcatcgcccacgaatgcggccaccacgccttcagcgactac

SEQ ID NO: 37911 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37912 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactacctcaagaaagcaatcccacctcactgcttcaaacgctccatcccacgctccttctcctcttcgacatcatcatctcctcctcggctcctccctctaccacctctccacagtctacttccctctcccttacctcgcctgacccctctactgggcctgccaaggctgcgtcctaacgggcctctgggtcatagcccacgagtgcggccaccacgccttcagcgactac

SEQ ID NO: 37913 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctgagacctcaagaaagcaatcccacctcactgcttcaaacgctccatcccacgctccttctcctcttcgacatcatcctctcctcctcggctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 37914 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggtcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37915 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 37916 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 37917 - DNA, 351 bp, Artificial
  Mutation in BnaC.FAD2.b introduced by TALE nuclease pair BnFAD2_T03
cagatccatgggtgcaggtagaagaatgcaagtctctcctccctccagctcccccggaaccaacaccctcaaacgcgtcccctgcgagacaccacccttcactccttagacctcaagaaagcaatcccacctcactgcttaaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 37918 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgtagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 37919 - DNA, 381 bp, Artificial
  Mutation in BnaC.FAD2.b introduced by TALE nuclease pair BnFAD2_T03
caggatccatgggtgcaggtggaagaatgcaagtctctcatccctccagctcccccgaaaccaaaaccctcaaacgcgtcccctgcgagacaccacccttcactctcgagcgccatctcgaaccgacgttgctggccgagacctcaagaaagcaatcccacctcactgcttcaaacgctccatccctcgctccttctcctacctcctcttcgacatcctcgtctcctcctccctctaccacctctccacagcctacttccctctcctccccaccctctcccttacctcgcctggcccctctactgggcctgccagggctgcgtcctaaccggcgtctgggtcatagcccacgagtgcggccaccacgccttcagcgactac

SEQ ID NO: 37920 - DNA, 332 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactctcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 37921 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37922 - DNA, 292 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37923 - DNA, 357 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37924 - DNA, 335 bp, Artificial
  Mutation in BnaC.FAD2.b introduced by TALE nuclease pair BnFAD2_T03
caggatccatgggtgcaggtgaaagaatgcaagtctgtcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcctacgagtgcggccaccacgccttcagcgactac

SEQ ID NO: 37925 - DNA, 382 bp, Artificial
  Mutation in BnaC.FAD2.b introduced by TALE nuclease pair BnFAD2_T03
caggatccatgggtgcaggtggaagaatgcaagtctctcctccctccggctcccccggaaccaacaccctcaaacgcgtcccctgcgagacaccaccattcactactgacagaaccgcagcgttgaaggagccactcagccgcgggtttctgagacctcaagaaagcaatcccacctcactgcttcaaacgctccatcccacgctccttctcctcttcgacatcatcatctcctcctcggctcctccctctaccacctctccccagcctacttccctctcccttacctcgcctgacccctctactgggcctgccaaggctgcgtcctaacgggcctctgggtcatagcccacgagtgcggccaccacgccttcagcgactac

SEQ ID NO: 37926 - DNA, 292 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 37927 - DNA, 335 bp, Artificial
  Mutation in BnaC.FAD2.b introduced by TALE nuclease pair BnFAD2_T03
caggatccgggtgcaggtgaaagaatgcaagtctctcctccctccagctcccccgaaaccaacaccctcaaacgcgtcccctgcgagacaccaccattcactcttgacctcaagaaagcaatcccacctcactgcttcaaacttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactaccacgccttcagcgactac

SEQ ID NO: 37928 - DNA, 334 bp, Artificial
  Mutation in BnaC.FAD2.b introduced by TALE nuclease pair BnFAD2_T03
cagaatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37929 - DNA, 351 bp, Artificial
  Mutation in BnaC.FAD2.b introduced by TALE nuclease pair BnFAD2_T03
caggatccatgggtgcaggatggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 37930 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacttaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37931 - DNA, 365 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggctcttgatccggcaaaaaaaccaccgctacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37932 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactgc

SEQ ID NO: 37933 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacccctcaagaaagcaatcccacctcactgcttcaaacgctccatccctcgctccttctcctacctcatcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37934 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37935 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccaccattcactctcgggagacctcaagaaagaaatccaacctcactgcttcaaactctccatcccaccctccttctcctcttcgacatcatcatctcctcctcggctcctccctctcccacctctccacagcctactaccctctcccttacctcgcctggcccctctactgggcctgccaaggctgcgtcctaacgggcctctgggtcatcgcccacgaatgcggccaccacgccttcagcgactac

SEQ ID NO: 37936 - DNA, 305 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 37937 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctcctccctctaccacctctccacagcctacttccctctcctcccccaccctctcccttccctcgcctggcccctctcctgggcctgccaaggctgcgtcctaacgggcctctgggtcatagcccacgagtgcggccaccacgccttcagcgactac

SEQ ID NO: 37938 - DNA, 397 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagccgaacgaccgagcgcagcgagtcagtgagcgaggaagcggaagagcgcccaatacgcggagacctcaacaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 37939 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgtcgagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37940 - DNA, 403 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagtcctgtcgggtttcgccacctctgacttgagcgtcgatttttgtgatgcccggagacctcaagaaagcaatcccacctcactgcttcaaacgctccatccctcgctccttctcctacctcctcttcgacatcctcgtctcctcctccctctaccccctctccacagcctgcttccctctcctcccccaccctctcccttacctcgcctgacccctctactgggcctgccaagcctgcgtcctaacgggcctctgggtcatagcccacgagtgcggccaccacgccttcagcgactac

SEQ ID NO: 37941 - DNA, 306 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 37942 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37943 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaaaaaagcaatcccacctcactgcttcaaacgctccatcccacgctccttctcctcttcgacatcatcatctcctcctcggctcctccctctaccacctctccacagcctacttccctctcccttacctcgcctgccccctctactgggcctgccaaggcggcgtcctaacgggcctctgggtcatagcccacgagtgcggccaccacgccttcagcgactac

SEQ ID NO: 37944 - DNA, 343 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgcttcaaacgctccatccctcgctccttctcctacctcctcttcgacatcatcatctcctcctcggctcctccctctaccacctctccacagcctgcttccctctcccttacctcgcctgacccctctactgggcctgccaaggctgcgtcctaacgggcctctgggtcatagcccacgagtgcggccaccacgccttcagcgactac

SEQ ID NO: 37945 - DNA, 319 bp, Artificial
  Mutation in BnaC.FAD2.b introduced by TALE nuclease pair BnFAD2_T03
caggatccacgggtgcaggtggaagaatgcaagtctctcctccctccagctcccccggaaccaacaccctcaaacgcgtcccctgcgagacaccacccttcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 37946 - DNA, 394 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgttcaaatccgctcccggcggatttgtcctactcaggtgaacgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 37947 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcatgccaaggctgcgtcctaacgggcctctgggtcatcgcccacgaatgcggccaccacgccttcagcgactac

SEQ ID NO: 37948 - DNA, 331 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctcaccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37949 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 37950 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccgcgaatgcggccaccacgccttcagcgactac

SEQ ID NO: 37951 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37952 - DNA, 347 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37953 - DNA, 402 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtaccctgcgagacaccgcccttcactggctggcgatggccaccacctgctggggggtcaagccgtgggcctggcacagcaccggcaacagccgctggacccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37954 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacctcaagaaagcaatcccacctcactgcttcaaacgctccatcccacgctccttctcctcttcgacatcatcatctcctcctcggctcctccttctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37955 - DNA, 344 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagaactcaagaaagcaatcccaccgcactgtttcaaacgctcgatcccacgctccttctcctcttcgacatcctcgtctcctcctccctctaccacctctccacagcctacttccctctcctcccccaccctctcccttacctcgcctggcgcctctactgggcctgccaaggctgcgtcctaacgggcctctgggtcatctcccacgaatgcggccaccacgccttcagcgactac

SEQ ID NO: 37956 - DNA, 281 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37957 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaaggaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcatcctaaccggcgtctgggtcatagcccacgagtgcggccaccacgccttcagcgactac

SEQ ID NO: 37958 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatccccccgcactgcttcaaacgctccatccctcgctccttctcctacctcctcttcgacatcctcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37959 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 37960 - DNA, 350 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaataccctcaaacgcgtcccctgcgagacaccaccattcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37961 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaacaaacaccctcaaacgcgtcccctgcgagacaccaccattcacacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37962 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 37963 - DNA, 330 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacccttcactctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37964 - DNA, 293 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactggcctgccagggctgcgtcctaacgggcctctgggtcatcgcccacgaatgcggccaccacgccttcagcgactac

SEQ ID NO: 37965 - DNA, 392 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtcccctgcgagacaccaccattcactctcgacgctcaagtcagaggtggcgaaacccgacaggactataaagataccaggcgttagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 37966 - DNA, 280 bp, Artificial
  Mutation in BnaC.FAD2.b introduced by TALE nuclease pair BnFAD2_T03
caggatccatgggtgcaggtggaagaatgcaagtgtctcctccctccagtctctccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37967 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactaagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccatctactgggcctgccaaggctgcgtcctaacgggcctctgggtcatcgcccacgaatgcggccaccacgccttcagcgactac

SEQ ID NO: 37968 - DNA, 342 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37969 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagaaagcaatcccacctcactgcttcaagcgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37970 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccatgccttcagcgactac

SEQ ID NO: 37971 - DNA, 315 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacaacatcatctcctcctcggctcctccctcaccctctctcctacttcgcctggcctctctactgggcctgccaagggtgcgtcctaaccggcgtctgtgtcataacccacgagtgctgccaccacgcccatcagcgactac

SEQ ID NO: 37972 - DNA, 408 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggagacggtccagcggctgttgccggtgctgtgccaggcccacggtccagcgcctgcttgccggagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37973 - DNA, 408 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccactcaaatccgctcccggcggatttgtcctactcaggagagcgttcaccgacaaacaacagataaaacgaagacctcaagaaagcaatcccacctccctgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37974 - DNA, 366 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactgattataagttacttactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37975 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtcccctgcgagacaccaccattaactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37976 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37977 - DNA, 378 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacttttggagcagcaacgatgttacgcagcaggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccgcgaatgcggccaccacgccgtcagcgactac

SEQ ID NO: 37978 - DNA, 425 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagcgcctgcttgccaccgccattgctggcgatggccaccacctgctccggggtcaagccgtgggcctggcacagcaccggcaacagccgctgacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37979 - DNA, 335 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtacccccagcaggtggtgaccatcgccagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 37980 - DNA, 347 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37981 - DNA, 308 bp, Artificial
  Mutation in BnaC.FAD2.b introduced by TALE nuclease pair BnFAD2_T03
caggatccatgggtgcaggtggaagaatgcaagtctctcctccctccagctcccccggaaccaagacctcaagaaagcaatcccacctcactgcttcaaacgctccatcccacgctccttctcctcttcgacatcatcatctcctcctcggctcctccctctaccacctatccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37982 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctcttcgacatcatcatctcctcctcggctcctccctctaccacctctccacagcctacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 37983 - DNA, 332 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 37984 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttccctcaagaaagcaatcccacctcactgcttcaaacgctccatccctcgctccttctcctacctcctcttcgacatcctcttctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgacgac

SEQ ID NO: 37985 - DNA, 392 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgcctgcttgccaccgccattgctggcgatggccaccacctttgacctcaagaaagcaatcccacctcactgcttcaaccgctccatccctcgctccttctcctacctcctcttcgacatcctcgtctcctcctccctctaccacctctccacagcctacttccctcgcctcccccaccctcgcccttacctcgcctggcccctctactgggcctgccaaggctgcgtcctaacgggcctctgggtcatcgcccacgaatgcggccaccacgccttcagcgactac

SEQ ID NO: 37986 - DNA, 351 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37987 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaagggtgcgtcctaaccggcgtctgggtcatagcccacgagtgcggccaccacgccttcagcgactac

SEQ ID NO: 37988 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37989 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccatcagcgactac

SEQ ID NO: 37990 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37991 - DNA, 311 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacacccccaaacgcgtcccctgcgagacaccaccattcactctcactgcttcaaaccctccatcccacgctccttctcctcttcgacatcatcacctcctcctcggctcctctctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 37992 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctcctcccccaccctctcccttacctcgcctggcccctctactgggcctgccaaggctgcgtcctaacgggcctctgggtcatcgcccacgaatgcggccaccacgccttcagcgactac

SEQ ID NO: 37993 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatccctcgctccttctcctacctcctcttcgacatcctcgtctcctcctccctctaccacctctccacagcctacttccctctcttcccccaccctctcccttacctcgcctggcccctctactgggcctgccaaggctgcgtcctaacgggcctctgggtcatcgcccacgaatgcggccaccacgccttcagcgactac

SEQ ID NO: 37994 - DNA, 347 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaccgaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 37995 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 37996 - DNA, 290 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcacgactac

SEQ ID NO: 37997 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 37998 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacggggcctgccaaggctgcgtcctaacgggcctctgggtcatagcccacgagtgcggccaccacgccttcagcgactac

SEQ ID NO: 37999 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38000 - DNA, 335 bp, Artificial
  Mutation in BnaC.FAD2.b introduced by TALE nuclease pair BnFAD2_T03
caggatccatgggtgcaggtggaagaatgcaagtctctcctccctccagctaccccgaaaccgaaaccatcaaacgcgtaccctgcgagacaccacccttcactctagacctcaagaagacaatcatccctccccgcttctacaaatccaccatccgcccctcctcctactccctcttctccatcctcctctcctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38001 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 38002 - DNA, 324 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgcactgtttcaaacgctccatccctcgctccttctcctacctcctcttcgacatcctcgtctcctcctccctctaccacctctccacagcctacttccctctcctccccccccctctcccttacctcgcctggcccctctactgggcctgccaaggctgcgtcctaacgggcctctgggtcatagcccacgagtgcggccaccacgccttcagcgactac

SEQ ID NO: 38003 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38004 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38005 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgtaaccaacaccctcaaacgcgtcccctgcgagacaccaccattcactcagacctcaagaaagcaatcccacctcactgcttcaaacgctccatcccacgctccttctcctcttcgacatcctcgtctcctcctccctctaccacctctccacagcctacttccctctccccccccaccctctcccttacctcgcctggcccctctactgggcctgccaaggctgcgtcctaacgggcctctgggtcatcgcccacgaatgcggccaccacgccttcagcgactac

SEQ ID NO: 38006 - DNA, 338 bp, Artificial
  Mutation in BnaC.FAD2.b introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcaagaaagcaatcccaccgcactgtttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38007 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggaaagcaatcccacctcaccgcttcaaacgctccatcccaccctccttctcctcttcgccatcatcatctcctcctcggcttctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38008 - DNA, 311 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38009 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccggagacctcaagaaagcaatcccacctcactgcttcaaacgctccatcccacgctccttctcctcttcgacatcatcatctcctcctcggctcctccctctaccacctctccacagcctacttccctctcccttccctcgcctgacccctctactgggcctgccaaggctgcgtcctaacgggcctctgggtcatagcccacgagtgcggccaccacgccttcagcgactac

SEQ ID NO: 38010 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctccatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38011 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 38012 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctctctctaccacctctccacagcctacttccctctcccttacctcgcctgacccctctactgggcctgccaaggctgcgtcctaaccggcgtcttggtcatagcccacgagtgcggccaccacgccttcagcgactac

SEQ ID NO: 38013 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcccttaccttgcctgacccctctactgggcctgccaaggctgcgtcctaacgggcctctgggtcatcgcccacgaatgcggccaccacgccttcagcgactac

SEQ ID NO: 38014 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcttcagcgactac

SEQ ID NO: 38015 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38016 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38017 - DNA, 265 bp, Artificial
  Mutation in BnaC.FAD2.b introduced by TALE nuclease pair BnFAD2_T03
caggatccatgggtgcaggtggaagaatgcaagtctctcctccctccagtctctccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 38018 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcacccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 38019 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 38020 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 38021 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactcc

SEQ ID NO: 38022 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggtcaccacgccttcagcgactac

SEQ ID NO: 38023 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccaagagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38024 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgctagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38025 - DNA, 301 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38026 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38027 - DNA, 383 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgagcaggtggtggccatcgccagccacgatggcggcaagcaggcgctggagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38028 - DNA, 319 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgcttcaaacgctccatccctcgctccttctcctacctcctcttcgacatcctcgtctcctcctccctctaccacctctccacagcctacttccctctcctcccccaccctctcccttacctcgcctgacccctctactgggcatgccaaggctgcgtcctaacgggcctctgggtcatagcccacgagtgcggccaccacgccttcagcgactac

SEQ ID NO: 38029 - DNA, 349 bp, Artificial
  Mutation in BnaC.FAD2.b introduced by TALE nuclease pair BnFAD2_T03
caggatccatgggtgcaggtggaagaatgcaagtctctcctccctccagctccaccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38030 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 38031 - DNA, 348 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccacctcactgcttcaaacgctccatccctcgctccttctcctacctcctcttcgacatcctcgtctcctcctccatctaccacctctccacagcctacttccctctcctcccccaccctctcccttccctcgcctggcccctctactgggcctgccaaggctgcgtcctaacgggcctctgggtcatagcccacgaatgcggccaccacgccttcagcgactac

SEQ ID NO: 38032 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatatcccacgagtgcggccaccacgccttcagcgactac

SEQ ID NO: 38033 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactccacctcactgcttcaaacgcttcatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38034 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38035 - DNA, 443 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccgtccagcggctgttgccggtgctgtgccaggcccacggcttgaccccggagcaggtggtggccatcgccagccacgatggcggccagcaggcgctggagagagacctcaagaaagcaatcccacctcactgcttcaaacgctccatcccacgctccttcccctcttcgacatcaccatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38036 - DNA, 358 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctcagcggctgttgccggtgctgtgccaggcccccgctcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38037 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 38038 - DNA, 363 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcgcggcgggtgtggtggttacgcgcaaagacctcaagaaagcaatccaacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 38039 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacggagacctcaagaaagcaatcccacctcactgcttcaaacgctccatccctcgctccttctcctatctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38040 - DNA, 355 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttttggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38041 - DNA, 442 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggctgttgccggtgctgtgccaggcccacggcttgaccccggagcaggtggtggccatcgccagccacgatggcggcaacagccgctggacagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38042 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38043 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaacgggcctctgggtcatagcccacgagtgcggccaccacgccttcagcgactac

SEQ ID NO: 38044 - DNA, 279 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttctacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 38045 - DNA, 382 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaacaccatcaacatcgtggctggcgatggccaccacctgtgccaggcccacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgtcaaggctgcgtcctaacgggcctctgggtcatcgcccacgaatgcggccaccacgccttcagcgactac

SEQ ID NO: 38046 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcggccacgaatgcggccaccacgccttcagcgactac

SEQ ID NO: 38047 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatcccacgctccttctcctcttcgacatcatcatctcctcctctgctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38048 - DNA, 349 bp, Artificial
  Mutation in BnaC.FAD2.b introduced by TALE nuclease pair BnFAD2_T03
caggatccatgggtgcaggtggaagaatgcaagtctctccttcctccagctcccccggaacgaaaaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctaccgggcctgccaaggctgcgtcctaacgggcctctgggtcatcgcccacgaatgcggccaccacgccttcagcgactac

SEQ ID NO: 38049 - DNA, 392 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttgggcctggcacagcaccggcaacagccgctggaccgtctccagcgcctgcttgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38050 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacactccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38051 - DNA, 345 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38052 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcacgactac

SEQ ID NO: 38053 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 38054 - DNA, 350 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaacatcaagcgcgtaccctgcgagacaccgcccttcactgtagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38055 - DNA, 312 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccctcaaacgcgtcccctgcgagacaccaccattcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccgcgaatgcggccaccacgccttcagcgactac

SEQ ID NO: 38056 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38057 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctacgagacaccaccattcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38058 - DNA, 300 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatatcccacgagtgcggccaccacgccttcagcgactac

SEQ ID NO: 38059 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacttggcctgccaaggctgcgtcctaacgggcctctgggtcatagcccacgagtgcggccaccacgccttcagcgactac

SEQ ID NO: 38060 - DNA, 324 bp, Artificial
  Mutation in BnaC.FAD2.b introduced by TALE nuclease pair BnFAD2_T03
caggatccatgggtgcaggtggaagaatgcaagtgtctcctccaccaacaccctcaaacacgtcccctgccaggcacctccattcactctcgggagacctcaagaacgcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38061 - DNA, 334 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtaccctgcgagacaccaccattcactcgacctcaagaaagcaatcccacctcactgcttcaaacgctccatcccaccctccttcccctcttcgacatcatcatctcctcctcggctcctccctctaccacctccccacagcctacttccctctcccttacctcgcctggcccctctactgggcctgccaaggctgcgtcctaacgggcctctgggtcatagcccacgagtgcggccaccacgccttcagcgactac

SEQ ID NO: 38062 - DNA, 265 bp, Artificial
  Mutation in BnaC.FAD2.b introduced by TALE nuclease pair BnFAD2_T03
caggatccatgggtgcaggtggaagaatgcaagtctctcctccctccagtctctccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtaatagcccacgagtgcggccaccacgccttcagcgactac

SEQ ID NO: 38063 - DNA, 281 bp, Artificial
  Mutation in BnaC.FAD2.b introduced by TALE nuclease pair BnFAD2_T03
caggatccatgggtgcaggtggaagaatgcaagtatctcatccctccaggtagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38064 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacagggcctgccaaggctgcgtcctaacgggcctctgggtcatcgcccacgaatgcggccaccacgccttcagcgactac

SEQ ID NO: 38065 - DNA, 334 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38066 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 38067 - DNA, 280 bp, Artificial
  Mutation in BnaC.FAD2.b introduced by TALE nuclease pair BnFAD2_T03
caggatccatgggtgcaggtggaagaatgcaagtctctcctccctccagtctctccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38068 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacacacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 38069 - DNA, 318 bp, Artificial
  Mutation in BnaC.FAD2.b introduced by TALE nuclease pair BnFAD2_T03
gcaggatccatgggtgcagatggaagaatgcaagtctctcctccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38070 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38071 - DNA, 379 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggggggtcaagccgtgggcctggcacagcaccgccaacagccgcagacctcaagaaagcaatcccacctcactgcttcaaacgcttcatcccacgctccttctcctcttcgacatcatcatctcctcctcggctcctccctctaccacctccccacagcctacttccctctcccttacctcgcctgacccctctactgggcctgccaaggctgcgtcctaacgggcctctgggtcatagcccacgagtgcggccaccacgccttcagcgactac

SEQ ID NO: 38072 - DNA, 306 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctccatcccgctctccttctcctacctcctcttcgacatcctcggctcctcctccctctaccacctctccaccgcctccttccctctcctcccccaccctctcccttacctcgcctggcccctctactgggcctgccaaggctgtgtcctaacgggcctctgggtcatcgcccacgaatgcggccaccacgccttcagcgactac

SEQ ID NO: 38073 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcccggcccctctactgggcctgccaaggctgcgtcctaacgggcctctgggtcatagcccacgagtgcggccaccacgccttcagcgactac

SEQ ID NO: 38074 - DNA, 383 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctgctggggggtcaagccgtgggcctggcacagcaccggcaacagccgctggaccggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38075 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcggcgactac

SEQ ID NO: 38076 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcgcgactac

SEQ ID NO: 38077 - DNA, 306 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38078 - DNA, 454 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgtccagcggctgttgccggtgctgtgccaggcccacggcttgaccccggagcaggtggtggccatcgccagcaatattggtggcaagcaggcgctggcacaaagacctcaagaaagcaatcccacctcactgcttcaaacgctccatcccacgctccttctcctcttcgacatcatcatctcctcctcggctcctccctctaccccctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38079 - DNA, 337 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 38080 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 38081 - DNA, 279 bp, Artificial
  Mutation in BnaC.FAD2.b introduced by TALE nuclease pair BnFAD2_T03
caggatccatgggtgcaggtggaagaatgcaagtgtctcctccctccagcaatcccacctcactgcttcaaacgcgcgatccctccgtccttctcctacctcctcttcgagatcctcggctcctcctccctctactacctctccacagcttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 38082 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccactctccttctcctcttcgacatcatcatctcctcctcggctcctccctctaccacctctccacagcctacttccctctcccttacctcgcctgacccctctactgggcctgccaagcctgcgtcctaacgggcctctgggtcctagcccacgagtgcggccaccacgccttcagcgactac

SEQ ID NO: 38083 - DNA, 334 bp, Artificial
  Mutation in BnaC.FAD2.b introduced by TALE nuclease pair BnFAD2_T03
caggatccatggggcaggtagaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 38084 - DNA, 324 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaaaacaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38085 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 38086 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctcgcccttacctcgcctggcccctctacggggcctgccaaggctgcgtcctaacgggcctctgggtcatcgcccacgagtgcggccaccacgcctgcagcgactac

SEQ ID NO: 38087 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38088 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaacgggcctctgggtcatagcccacgagtgcggccaccacgccttcagcgactac

SEQ ID NO: 38089 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctaaacctcaagaaagcaatcccacctcactgcttcaaacgctccatccctcgctccttctcctacctcctcttcgacatcctcgtctcctcctccctctaccacctctccacaacctacttccctctcctcccccaccctctccctcacctcgcctggcccctctactgggcctgccaaggctgcgtcctaacgggcctctgggtcatcgcccacgaatgcggccaccacgccttcagcgactac

SEQ ID NO: 38090 - DNA, 330 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcacactcaagaaagcaatcccaccgcactgtttcaaacgctcaatcccacgctccttctcctcttcgacatcatcatctcctcctcggctcctccctctaccacctctccacagcctacttccctctcccttacctcgcctgacccctctacagggcctgccaaggctgcgtcctaacgggcctctgggtcatatcccacgagtgcggccaccacgccttcagcgactac

SEQ ID NO: 38091 - DNA, 337 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcacttctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38092 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 38093 - DNA, 337 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactctgagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38094 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaactcctccctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38095 - DNA, 397 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagccgaacgaccgagctcagcgagtcagtgagcgatgaagcggaagagcgcccaatacgcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38096 - DNA, 291 bp, Artificial
  Mutation in BnaC.FAD2.b introduced by TALE nuclease pair BnFAD2_T03
caggatccatgggtgcaggtggaagaatgcaagtcgctcccccctccagcgcccccgaaaccaaaaccctcaaacgcaagcccccctcactgcgtcaaacgctccatcccgctctccgtctcctacctcctcttcgccatcctcggctcctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38097 - DNA, 346 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacatcatcaagcgcgtaccctgcgcgacaccgcccttcactgactcaagaaagcaatcccaccgcactgtttcaaactctccatccctcgctccttctcctacctcctcttcgacatcctcgtctcctcctccctctaccacctctccacagcctacttccctctcctcccccaccctctcccttacctcgcctggcccctctgcggggcctgccaaggctgcgtcctaacgggcctctgggtcatcgcccacgaatgcggccaccacgccttcagcgactac

SEQ ID NO: 38098 - DNA, 320 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactctatcccacctcactgcttcaaacgctccatccaacgctccttctcctcttcgacatcatcatctcctcctcggctcctccctctaccacctctccacagcctacttccctctcccttacctcgcctgacccctctactgggcctgccggggctgcgtcctacccggcgtctgggtcataccccacgagggcggccaccacgccttcagcgactac

SEQ ID NO: 38099 - DNA, 319 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccgccctccactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 38100 - DNA, 358 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggcggcaagcaggcgctggaggagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 38101 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcctctctactgggcctgccaaggctgcgtcctaacgggcctctgggtcatagcccacgagtgcggccaccacgccttcagcgactac

SEQ ID NO: 38102 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaaggctgcgtcctaacgggcctctgggtcatcgcccacgaatgcggccaccacgccttcagcgactac

SEQ ID NO: 38103 - DNA, 415 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcgccagccacgatggcggcaagcaggcgctggagacggtccagcggctgttgtcggtgctgtgccagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctcacgggcctctgggtcatcgcccacgaatgcggccaccacgccttcagcgactac

SEQ ID NO: 38104 - DNA, 378 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgcttgaccccggagcaggtggtggccatcaccaaagacctcaagaaagcaatcccacctcactgcttcaaacgctccatccctcgctccttctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 38105 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccaacgcgtcccctgcgagacaccacccttcactcagacctcaagaaagcaatcccacctcactgcttcacacgctccatccctcgctccttctcctacctcctcttcgacatcctcgtctcctcctccctctaccacctctccacagcctacttccctctcctcccccaccctctcccttacctcgcctggccccgctactgggcctgccaaggctgcgtcctaacgggcctctgggtcatcgcccacgaatgcggccaccacgccgtcagcgactac

SEQ ID NO: 38106 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctcttcgacatcatcatctcctcctcggctcctccctctaccacctctccacagcctacttccctctcctcccccaccctctcccttcccgcgcctggcccctctactgggcctgccaaggctgcgtcctaacgggcctatgggtcatcgcccacgaatgcggccaccacgccttcacgactac

SEQ ID NO: 38107 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtcgcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38108 - DNA, 414 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactggcacagcaccggcaacagccgctggaccgtcaggatggccttctgcttagtttgatgcctggcagtttatggcgggcaggaacctcaataaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 38109 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 38110 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattagacctcaagaaagcaatcccacctcactgcttcaaacgctccatcccacgctccttctcctcttcgacatcatcatctctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 38111 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacggggcctgccaaggctgcgtcctaacgggcctctgggtcatagcccacgagtgcggccaccacgccttcagcgactac

SEQ ID NO: 38112 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtaccctgcgagacaccacccttcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38113 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaagcgcgtaccctgcgagacaccgcccttcactgtagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38114 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 38115 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgtgtcctaacgggcctctgggtcatagcccacgagtgcggccaccacgccttcagcgactac

SEQ ID NO: 38116 - DNA, 332 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaactcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38117 - DNA, 349 bp, Artificial
  Mutation in BnaC.FAD2.b introduced by TALE nuclease pair BnFAD2_T03
caggatccatgggtgcaggtggaagaacgcaagcgtctcctccctccaagaagtctgaaaccgacaccatcaagctcgtaccctgcgagacaccgcccttcactgagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctagcgggcctctgggtcatcgcccacgaatgcggccaccacgccttcagcgactac

SEQ ID NO: 38118 - DNA, 410 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagttgccggtgctgtgccaggcccacggcttgaccccccagcaggtggtggccatcgccagcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 38119 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcacacggacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38120 - DNA, 386 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcggcctttttacggttcctggccttttgctggccttttgctcacatgttctttcctgcgttatcccccgggagacctcaagaaagcaatcccacctcactgcttcaaacgctccatcccacgctccttctcctcttcgacatcatcatctcctcctcggctcctccctctaccacctccccacagcctccttccctctcccttacctcgcctgacccctctactgggcctgccaaggctgcgtcctaacgggcctctgggtcatagcccacgagtgcggccaccacgccttcagcgactac

SEQ ID NO: 38121 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccaccctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccgcgagtgtggccaccacgccttcagcaactac

SEQ ID NO: 38122 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcattacttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38123 - DNA, 335 bp, Artificial
  Mutation in BnaC.FAD2.b introduced by TALE nuclease pair BnFAD2_T03
caggatccatgggtgcaggtggaagaatacaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctaccaaggctgcgtcctaacgggcctctgggtcatagcccacgagtgcggccaccacgccttcagcgactac

SEQ ID NO: 38124 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccacccttacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38125 - DNA, 356 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcggagacctcaagaaagcaatcccaccgcactgcttcaaacgctccatccctcgctccttctcctacctcctcttcgacctcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38126 - DNA, 334 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38127 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctttagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccatcagcgactac

SEQ ID NO: 38128 - DNA, 350 bp, Artificial
  Mutation in BnaC.FAD2.b introduced by TALE nuclease pair BnFAD2_T03
taggatccatgggtgcaggtggaagaatgcaagtgtctcctccctccaagaagtctgaaaccgacaccatcaagcgcgtaccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38129 - DNA, 414 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggggcggagcctatggaaaaacgccaggaaccgtaaaatatcaaccatagtacgcgccgctagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38130 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccgtcagcgactac

SEQ ID NO: 38131 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaataaagcaatcccacctcactgcttcaagcgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagccaacgagtgcggccaccacgccttcagcgactac

SEQ ID NO: 38132 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccatcaaacgcgtcccctgcgagacaccacccttcacgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38133 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgatccatccctctctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38134 - DNA, 334 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38135 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcgatcccacctcactgcttcaaacgctccatcccacgctccttctcctcttcgacattatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38136 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 38137 - DNA, 347 bp, Artificial
  Mutation in BnaC.FAD2.b introduced by TALE nuclease pair BnFAD2_T03
caggatatgggtgcaggtgaaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38138 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 38139 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 38140 - DNA, 356 bp, Artificial
  Mutation in BnaC.FAD2.b introduced by TALE nuclease pair BnFAD2_T03
caggatccatgggtgcaggtggaagaatgcaagtctctcctccatccagctcccccgaaaccaaaaccctcaaacgcgtcccctgcgagacaccacccttcactctcggcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 38141 - DNA, 430 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggctgttgccggtgctgtgccaggcccacggcttgacccccagcaggtggtggccatcgccagcaatggcggtggcaagcaggcgctggagacggacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38142 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38143 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaaactcaagaaagcaatcccaccgcactgtttcaaacgctcgatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38144 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38145 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaacctcaataaagcaatcccacctcactgcttcaaacgctccatcccacgctccttctcctcttcgacatcatcatctcctcctcggctcctccctctaccacctctccacagcctacttccctctccctaacctcgcctgacccctctactgggcctgccaaggctgcgtcctaacgggcctctgggtcatagcccacgagtgcggccaccacgccttcagcgactac

SEQ ID NO: 38146 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 38147 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38148 - DNA, 351 bp, Artificial
  Mutation in BnaC.FAD2.b introduced by TALE nuclease pair BnFAD2_T03
cagaatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38149 - DNA, 345 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttgagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38150 - DNA, 411 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggtggcaagcaggcgctggagacggtccagcggctgttgccggtgctgtgccaggcccacggcttgaccccggaagacctcaagaaagcaatcccacctcactgcttcaaacgctccatcccacgctccttctcctcttcgacatcatcacctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38151 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgatacaccacccttcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38152 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 38153 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccatcactgagacctcaagaaagcaatcccacctcactgcttcaaacgctccatccctcgctccttctcctacctcctcttcgacgtcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38154 - DNA, 334 bp, Artificial
  Mutation in BnaC.FAD2.b introduced by TALE nuclease pair BnFAD2_T03
caggatccattggtgcaggtggaagaatgcaagtgtctcctccctccaagaagtctgaaaccgacaccatcaagcgcgtaccctgcgagacaccgcccttcactggaactcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcgtctgggtcatagcccacgagtgcggccaccacgccttcagcgactac

SEQ ID NO: 38155 - DNA, 332 bp, Artificial
  Mutation in BnaC.FAD2.b introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcacgaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38156 - DNA, 335 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 38157 - DNA, 396 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcagcggatttgtcctactcaggagagcgttcaccgacaaacaacagataaaacgaaaggcccagtcttccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38158 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctcaccggcgtctgggtcatagcccacgagtgcggccaccacgccttcagcgactcc

SEQ ID NO: 38159 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 38160 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacggggcctgccaaggctgcgtcctaaccggcgtctgggtcatagcccacgagtgcggccaccacgccttcagcgactac

SEQ ID NO: 38161 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38162 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38163 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacggggcctgccaaggctgcgtcctaacgggcctctgggtcatcgcccacgaatgcggccaccacgccttcagcgactac

SEQ ID NO: 38164 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcccttacctcgcctggcccctctactgggcctgccaaggctgcgtcctaacgggcctctgggtcatctcccacgaatgcggccaccacgccttcagcgactac

SEQ ID NO: 38165 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38166 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaacacgccttcagcgactac

SEQ ID NO: 38167 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccacctcactgcttcaaactctccatccctcgctccttctcctacctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38168 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagaacctcaagaaatcaatcccacctcactgcttcaaacgctccatccctcgctccttctcctacctcctcttcgacatcctcttctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38169 - DNA, 418 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactctcggcggatttgtcctactcaggagagcgttcaccgacaaacaacagataaaacgaaaggctcagtctttgacctcaagaaagcaatcccacctcactgcttcaaacgctccatccctcgctccttctcctacctcctcttcgacatcctcgtctcctcctccccctaccacctctccacagcctactcccctctcctccccccccctctcccttacctcgcctggcccctctactgggcctgccaaggctgcgtcctaacgggcctctgggtcatagcccacgagtgcggccaccacgccttcagcgactac

SEQ ID NO: 38170 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 38171 - DNA, 319 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38172 - DNA, 342 bp, Artificial
  Mutation in BnaC.FAD2.b introduced by TALE nuclease pair BnFAD2_T03
caggatccatgggtgcaggtggaagaatgcaagtccctcctccctccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38173 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38174 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccgaggctgcgtcctaacgggcctctgggtcatagcccacgagtgcggccaccacgccttcagcgactac

SEQ ID NO: 38175 - DNA, 345 bp, Artificial
  Mutation in BnaC.FAD2.b introduced by TALE nuclease pair BnFAD2_T03
caggatccatgggtgcaggtggaagaatgaaagtctctcctccctccagctcccccgaaaccaaaaccctcaaacgcgtcccctgcgagacaccacccttcactctcggagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38176 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcacccacgaatgcggccaccacgccttcagcgactac

SEQ ID NO: 38177 - DNA, 343 bp, Artificial
  Mutation in BnaC.FAD2.b introduced by TALE nuclease pair BnFAD2_T03
caggatccatgggtgcaggtggaagaatgcaagtgtctcctccctccagctcccccggaaccgacaccatcaagcgcgtaccctgcgagacaccgcccttcactgtagaactcaagaaagcaatcccaccgcactgtttcaaacgctcgatccctcgctctttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38178 - DNA, 314 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcatcccacctcactgcttcaaacgctccatccctcgctccttctcctacctcctcttcgacatcctcgtctcctcctctctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 38179 - DNA, 325 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccatgacagacctcaagaaagcaatcccacctcactgcttcaaacgctccatcccacgctccttctcctcttcgacatcatcatctcctcctcggctcctccctctaccacctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38180 - DNA, 338 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccaccattcactctagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38181 - DNA, 347 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcacagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38182 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38183 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactcacctcaagaaagcaatcccacctcactgcttcaaacgctccatcccacgctccttctcctcttcgacatcatcatctcctcctctgctactccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 38184 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcacctcaagaaagcaatcccacctcactgcttgaaacgctccatcccacgctccttctcctcttcgacatcatcatctcctcctccctctaccacctctccacagcctacttccctctcctcccccaccctctcccttgcctcgcctggcccctctactgggcctgccaaggctgcgtcctaacgggcctctgggtcatcgcccacgaatgcggccaccacgccttcagcgactac

SEQ ID NO: 38185 - DNA, 355 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38186 - DNA, 331 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38187 - DNA, 296 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgattgcggccaccacgccttcagcgactac

SEQ ID NO: 38188 - DNA, 390 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggtggccatcgccagcaatggcggtggcaacagccgctggagacctcaagaaagcaatcccacctcactgcttcaaacgctccatccctcgctccttctcctacctccccttcgccatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38189 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgccccctgcgagacaccaccactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38190 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctctctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38191 - DNA, 304 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtttcaaaccctccatccctcgctccttctcctacctcctcttccacatcctcgtctcctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38192 - DNA, 362 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaatggcggtggcaagcaggcgctggagagacctcaagaaagcaatcccacctcactgcttcaaacgctccatcccacgctccttctcctcttcgacatcatcatctcctcctcagctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38193 - DNA, 329 bp, Artificial
  Mutation in BnaC.FAD2.b introduced by TALE nuclease pair BnFAD2_T03
caggatctatgggtgcaggtggaagaatgcaagtctctcctccctccagctcccccggaaccaacaccctcaaacgcgtcccctgcgagacaccaccattcactctcggaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtcctaacgggcctctgggtcatagcccacgagtgcggccaccacgccatcagcgactac

SEQ ID NO: 38194 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 38195 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaactctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38196 - DNA, 274 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacctcactgcttcaaacgctccatcccacgctccttctcctcttcgacatcatcatctcctcctcggctactccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 38197 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacccacaaacgcgtcccctgcgagacaccaccattcaccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38198 - DNA, 335 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaacgcgtcccctgctagacaccaccattcactcagacctcaagaaagcaatcccacctcactgcttaaaacgctccatcccaccctccttctcctcttcgacatcatcatctcctcctcgcctcctccctctaccacctctccacagcctacttccctctcccttacctcgcctgacccctctactgggcctgccaacgctgcgtcctaacgggcctctgggtcatagcccacgagtgcggccaccacgccttcagcgactac

SEQ ID NO: 38199 - DNA, 349 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaacgcgtcccctgcgagacaccaccattcactcggacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 38200 - DNA, 350 bp, Artificial
  Mutation in BnaC.FAD2.b introduced by TALE nuclease pair BnFAD2_T03
caggatccatgggtgcaggaggaagaatgcaagtctctcctccctccagctcccccggaaccaacaccctcaaacgcgtcccctgcgagacaccaccattcactctagacgtcaagaaggcaatcccacctcactgcttcaaacgctccatccctcgctccgtctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38201 - DNA, 337 bp, Artificial
  Mutation in BnaC.FAD2.b introduced by TALE nuclease pair BnFAD2_T03
caggatccatgggtgcaggtggaagaatgcaagtctctcctccctccagcttccccggaaccaacaccctcaaacgcgtcccctgcgagacaccaccattcactctcgaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38202 - DNA, 280 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38203 - DNA, 263 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaagaaagcaatcccacctcactgcttcaaacgctccatccctcgctccttctcctacctcctcttcgacatcctcgtctcctcctccctcaccctctctcctacttcgcctggcctctctactgggcctgccagggctgcgtcctaaccggcgtctgggtcatagcccacgagtgcggccaccacgccttcagcgactac

SEQ ID NO: 38204 - DNA, 295 bp, Artificial
  Mutation in BnaC.FAD2.b introduced by TALE nuclease pair BnFAD2_T03
caggatccatgggtgcaggtggaagaatgcaagtctctcatccctccaggtagacctcaagaaagcaatcccacctcactgcttcaaacgctccatccctcgctccttctcctacctcctcttcgacatcctcgtctcctcctccctctaccacctctccacagcctacttccctctcctccctcagcctctcccttacctcgcctggcccctctactgggcctgccaaggctgcgtcctaacgggcctctgggtcatcgcccacgaatgcggccaccacgccttcagcgactac

SEQ ID NO: 38205 - DNA, 340 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38206 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaacgggcctctgggtcatagcccacgagtgcggccaccacgccttcagcgactac

SEQ ID NO: 38207 - DNA, 378 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgcgatggcggcaaccaggcgctggagaagacctcaagaaagcaatcccacctcactgcttcaaacgctccatcccacgctccttctcctcttcgacatcatcatcgcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38208 - DNA, 306 bp, Artificial
  Mutation in BnaC.FAD2.b introduced by TALE nuclease pair BnFAD2_T03
caggatccatgggtgcaggtggaagaatgcaagtctctcctcactccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38209 - DNA, 448 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccccagcaggtggtgaccatcgccagcaataatggtggcaagccagcggctgttgccggtgctgtgccaggcccacggcttgaccccccagcaggtggtggccatcgccagcaaaactcaagaaagcaatcccacctcactgcttcaaacgctccatccctccctccttctcctacctcccctccgccatcctcgtctcctcccccctctaccacctctccacagcctacttccctctccgcccccaccctctcccttacctcgcctggcccctctactgggcctgccaaggctgcgtcctaacgggcctctgggtcatcgcccacgaatgcggccaccacgccttcagcgactac

SEQ ID NO: 38210 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38211 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcctcgtctcctactccctctaccacctctccacagcctacttccctctcctcccccaccctctcccttacctcgcctggcccctctactgggcctgccaagggtgcgtcctaacgggcctctgggtcatcgcccgcgaattcggccaccacgccttcagcgactac

SEQ ID NO: 38212 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccaagacctcaagaaagcaatcccacctcactgcttcaaacgctccatcccacgctccttctcctcttcgacatcatcatctcctcctcggctcctccttctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38213 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccctgacctcaagaaagcaatcccacctcactgcttcaaacgctccatccctcgctccttttcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38214 - DNA, 304 bp, Artificial
  Mutation in BnaC.FAD2.b introduced by TALE nuclease pair BnFAD2_T03
caggatccatgggtgcaggtggaagaatgcaagtctctcctccctacagctcccccgaaaccaaaaccctcaaacgcgtcccctgcgagacaccacccttcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38215 - DNA, 273 bp, Artificial
  Mutation in BnaC.FAD2.b introduced by TALE nuclease pair BnFAD2_T03
caggatcatgggtgcaggtggaagaatgcaagtctctcctccctccagctcccccggaaccaacacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38216 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctggagacatcaagaaagcaatcccacctcactgcttcaaacgctccatcccacgctccttctcctcttcgacatcatcatctcctcctcggctcctccatctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38217 - DNA, 295 bp, Artificial
  Mutation in BnaC.FAD2.b introduced by TALE nuclease pair BnFAD2_T03
caggatccatgggtgcaggtggaagaatgcaagtctctcatccctccaggtagacctcaagaaagcaatcccacctcactgcttcaaacgctccatccctcgctccttctcctacctcctcttcgacatcctcgtctcctcctccctctaccacctctccacagcctacttccctctcctccctcagcctctcccttacctcgcctggcctctctactgggcctgccagggctgcgtcctaaccggcgtctgggtcatagcccacgagtgcggccaccacgccttcagcgactac

SEQ ID NO: 38218 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgtggccaccacgccttcagcgactac

SEQ ID NO: 38219 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcacagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38220 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggttatagcccacgagtgcggccaccacgccttcagcgactac

SEQ ID NO: 38221 - DNA, 442 bp, Artificial
  Mutation in BnaC.FAD2.b introduced by TALE nuclease pair BnFAD2_T03
caggatccatgggtgcaggtggaagaatgcaagtcgctcctccctccagctccccggaaccaacaccctcaaacgcgtcccctgctagacaccaccattcactctcggagaagaaatccgacgtgaggcacaagctgaattacgtgccccacgagtacatcgatctgatcgagatcgcccggaacagcacccaggaccgtatcctggagatgaaacctcaagaaagcaatcccacctcactgcttcaaacgctccatcccacgctccttctcctcttcgccatcatcatctcctcctcggctcctccctctcccacctctccacagcctccttccctctcccttacctcgcctgacccctctcctgggcctgcccaggctgcgtcctaacgggcctctgggtcctcgcccacgagtgcggcccccccgccctcagcgactcc

SEQ ID NO: 38222 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacccctcaagaaagcaatcccacctcactgcttcaaacgctccatccctcgctccttctcctacctcctcttcgacatcctcgtctcctcctccctctgccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38223 - DNA, 365 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttgaacgctctcctgagtaggacaaatccgctccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38224 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaataaatcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggcccccacgccttcagcgactac

SEQ ID NO: 38225 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcatgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 38226 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38227 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 38228 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgcaaggctgcgtcctaacgggcctctgggtcatcgcccacgaatgcggacaccacgccttcagcgactac

SEQ ID NO: 38229 - DNA, 257 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38230 - DNA, 337 bp, Artificial
  Mutation in BnaC.FAD2.b introduced by TALE nuclease pair BnFAD2_T03
caggatccatgggtgcaggtgaaagaatgcaagtgtctcctccctccaaaaagtccgaaaccgacaccatcaagcgcgtaccctgcgagacaccgcccttcactgtcagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38231 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacagcctcaaaggcttcccttgcgagaccccaccattcactagacctcaagaaagcaatcccacctcactgcttcaaacgctccatcccacgccccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38232 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtccactgcgagacaccacccttcacagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38233 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccatcggagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38234 - DNA, 265 bp, Artificial
  Mutation in BnaC.FAD2.b introduced by TALE nuclease pair BnFAD2_T03
caggatccatgggtgcagctggaagaatgcaagtctctcctccccccagtctctccacctcactgcttcaaacgctccatcccacgctccttctcctcttcgacatcatcatctcctcctctgctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38235 - DNA, 352 bp, Artificial
  Mutation in BnaC.FAD2.b introduced by TALE nuclease pair BnFAD2_T03
caggatccatgggtggcagatggaagaatgcaagtctctcctccctccagctcccccgaaaccaaaaccctcaaacgcgtcccctgcgatacaccacccttcactctagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38236 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 38237 - DNA, 392 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttcttcctggctagcggtacgcgtattaattgcgttgcgctcactgcccgctttccagagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38238 - DNA, 335 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38239 - DNA, 272 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38240 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcggagacctcaagaaagcaatcccacctcactgcttcaaacgctccatccctcgctccttctcctacctcctcttcgacatcctcgtctcctcctccctcgaccacctctccacagcctacttccctctcccttacctcgcctgacccctctacggggcctgccaaggctgcgtcctaacgggcctctgggtcatcgcccacgaatgcggccaccacgccttcagcgactac

SEQ ID NO: 38241 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38242 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgttgcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatcgcccacgaatgcggccaccacgccttcagcgactac

SEQ ID NO: 38243 - DNA, 348 bp, Artificial
  Mutation in BnaC.FAD2.b introduced by TALE nuclease pair BnFAD2_T03
caggatccatgggtgcaggtggaagaatgcaagtctctcctccctccagcaaccccggaaccaacaccatcaagcgcgtcccctgcgagacaccgcccttcactatacgtcaagaaagcaaacccacctcactgcttcaaacgctccatccctcgctccttctcctccctcctcttcgacatcctcgtctcctcctccctctaccacctctccacagcctacttccctctcctcccccaccctctcccttacctcgcctggcctctctactgggcctgccaaggctgcgtcctaacgggcctctgggtcatcgcccacgaatgcggccaccacgccttcagcgactac

SEQ ID NO: 38244 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 38245 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagctactac

SEQ ID NO: 38246 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatcgcccacgaatgcggccaccacgccttcagcgactac

SEQ ID NO: 38247 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38248 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38249 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccaagagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 38250 - DNA, 414 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcttgaccccggagcaggtggtggccatcgccagccacgatggcggcaacagccgctggaccagacctcaagaaagcaatcccacctcactgcttcaaacgctccatccctcgctccttctcctacctcctcttcgacattctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 38251 - DNA, 404 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgtctccagcgcctgcttgccgccatcgtggctggcgatggccaccacctgctccggactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38252 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccaacgcgtcccctgcgagacaccacccttcaagaaagcaatcccacctcacttcttcaaacgctccatccctcgctccttctcctacctcctcttcgccatcctcgtctcctcctccctctaccacctctccacagcctacttccctctcctcccccaccctctcccttacctcgcctggcccctctactgggcctgccaaggcggcgtcctaacgggcctctgggtgatcgcccacgaatgcggccaccacgccttcagcgactac

SEQ ID NO: 38253 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggagccaacaccctcaaacgcgtcccctgcgagacaccaccattcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38254 - DNA, 346 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctcccccctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38255 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgcacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggggcgtcctaaccggcgtctgggtcatagcccacgagtgcggccaccacgccttcagcgactac

SEQ ID NO: 38256 - DNA, 329 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttggaagcaatcccaccgcactgtttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 38257 - DNA, 322 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacccttaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38258 - DNA, 331 bp, Artificial
  Mutation in BnaC.FAD2.b introduced by TALE nuclease pair BnFAD2_T03
caggacccatgggtgcaggtggaagaatgcaagtctctcctccctccagctcccccgaaaccaaaaccctcaaacgcgtcccctctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38259 - DNA, 348 bp, Artificial
  Mutation in BnaC.FAD2.b introduced by TALE nuclease pair BnFAD2_T03
caggatccatgggtgcaggtgccagaatgcaagtaactcatccatacagctccaccgaaaccaaaaccctccaacgcgtcccctgcgagccaccacccttcactcgacctcaagaaagcaatcccaactcactgcttcaaacgctacatccctcgctccttctcctacctcctcttcgacatcctcgtctcctcctccctctaccacctctccacagcctaattccctctcctcccccaccctctcccttacctcgcctggcccctctactgggccggccaaggcagcggcctaacgggcctgtgggtcttcgcccacgaatgcggccaccacgccatcagctactac

SEQ ID NO: 38260 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccagccttcagcgactac

SEQ ID NO: 38261 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 38262 - DNA, 386 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcggcaccggcaacagccgctggaccgtctccagcgcctgcttgccaccagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 38263 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 38264 - DNA, 350 bp, Artificial
  Mutation in BnaC.FAD2.b introduced by TALE nuclease pair BnFAD2_T03
caggatccatgggtgcaggtggcagaatacaagtctctcatccctccagctcccccgaaaccaaaaccctcaaccgcgtcccctgcgagacaccacccttcactcaagacctcaagaaagcaatcccacctcactgcttcaaacgctccatccctcgcgccttctcctacctcctcttcgacatcctcgtctcctcctccctctaccacctctccacagcctacttccctctcctccccccccctctcccttacctcgcctggcccctctactgggcctgccatggctgcgtccgaacgggcctctgggtcatagcccacgagtgcggccaccacgccatcagcgactac

SEQ ID NO: 38265 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcacttcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38266 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacttaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 38267 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38268 - DNA, 360 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgcgacgcggagaactcaagaaagcaatcccaccgcactgtttcaaacgctcgatccctcgctccttctcctacctcctcttcgacatcctcgtctcctcctccctctaccacccctccacagcctacttccctctcctccccccccctctcccttccctcgcctggcccctctactgggcctgccaaggctgcgtcctaacgggcctctgggtcatagcccacgagtgcggccaccacgccttcagcgactac

SEQ ID NO: 38269 - DNA, 354 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggagacctcaagaaagcaatcccaccgcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38270 - DNA, 336 bp, Artificial
  Mutation in BnaC.FAD2.b introduced by TALE nuclease pair BnFAD2_T03
caggatccatgggtgcaggtggaagaatgcaagtctctcctccctacagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 38271 - DNA, 423 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctctccagcgtctgtttccggtgctgtgccaggcccacgacttgaccccccagcaggtggtggccatcgccagcgagacctcaagaaagcaatcccacctcactgcttcaaaccctccatccctcgcgccttctcctacctcctcttcgacatcctcgtctcctcctccctctaccacccctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38272 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcctttctttctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38273 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38274 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 38275 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacaagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 38276 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccgcgaatgcggccaccacgccttcagcgactac

SEQ ID NO: 38277 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgtggccaccacgccttcagcgactac

SEQ ID NO: 38278 - DNA, 319 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtatcccaccgcactgtttcaaacgctcgatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38279 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38280 - DNA, 337 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38281 - DNA, 350 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttgccgcgcctggcccctctactgggcctgccaaggctgcgtcctaacgggcctctgggtcatagcccacgagtgcggccaccacgccttcagcgactac

SEQ ID NO: 38282 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtccccacgcgtcccagcaatggcggtggcaagcaggcgctggagacctcaagaaagcaatcccacctcactgcttcaaacgctccatcccacgctccttctcctcttcgacatcatcatctcctcctcggctcctccctctaccacctctccacagcctacttccctctccattacctcgcctgacccctctactgggcctgccaaggctgcgtcctaacgggcctctgggtcatagcccacgagtgcggccaccacgccttcagcgactac

SEQ ID NO: 38283 - DNA, 294 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 38284 - DNA, 341 bp, Artificial
  Mutation in BnaC.FAD2.b introduced by TALE nuclease pair BnFAD2_T03
cagatccatgggtgcaggtagaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38285 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 38286 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcttcactgcttcaaacgctccatccctcgctccttctcctacctcatcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38287 - DNA, 336 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38288 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattagacctcaagaaagcaatcccacctcactgcttcaaacgctccatccctcgctccttctcctacctcctcttcgacatcctcgtctcctcctccctctaccacctctccacatcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38289 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacggacctctgggtcatagcccacgagtgcggccaccacgccttcagcgactac

SEQ ID NO: 38290 - DNA, 352 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaacgcgtcccctgcgagacaccaccattcactctaagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38291 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38292 - DNA, 348 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacaccacccttcacttaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38293 - DNA, 365 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttgaccccggagcaggtggtggccatcgccagccacgatggcggcaagcaggcgacctcaagaaagcaatcccacctcactgcttcaaacgctccatcccacgctccttctcctcttcgacatcatcatctcctcctcggctcctccctcaccctctctcctacttcgcctggcctctctactgggcctgccagggctgcgtcctaaccggcgtctgggtcatagcccacgagtgcggccaccacgccttcagcgactac

SEQ ID NO: 38294 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacccgtcccctgcgagacaccaccattcactcagacctcaagaacgcaatcccacctcactgcttcaaacgctccatcccacgctccttctcctacctcctcttcgacatcatcatctcctcctcggctcctccctctaccacctctccacagcctacttccctctcccttacctcgccggacccctctactgggcctgccaaggctgcgtcctaacgggcctctgggtcatagcccacgagtgcggccaccacgccttcagcgactac

SEQ ID NO: 38295 - DNA, 336 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgagtgcggccaccacgccttcagcgactac

SEQ ID NO: 38296 - DNA, 329 bp, Artificial
  Mutation in BnaC.FAD2.b introduced by TALE nuclease pair BnFAD2_T03
caggatccatgggtgcaggtggaagaatgcaagtccctcctccctccagctcccccggaaccaacaccctcaaacgcgtcccctgcgagacaccaccattcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccgtcagcgactac

SEQ ID NO: 38297 - DNA, 448 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccaaaaccctcaaacgcgtcccctgcgagacgtccaccacagcaccgttcaccagtagcaccattaccattagcaaggccggaaacgtcaccaatgaaaccgtcgatagcagcaccgtaatcagtagcgacagaatcaagtttgagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 38298 - DNA, 333 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccatgcgagacaccaccattcactcacctcaagaaagcaatcccacctcactgcttcaaacgctccatcccacgctccttctcctcttcgacatcataatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38299 - DNA, 376 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgctgcgtaacatcgttgctgctccagagacctcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgtgtcctaacgggcctctgggtcatcgcccacgaatgcggccaccacgccttcagcgactac

SEQ ID NO: 38300 - DNA, 385 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttccccggagcaggtggtggccatcgccagcaatattggtggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38301 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38302 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgagtgcggccaccacgccttcagcgactac

SEQ ID NO: 38303 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaagcgcgtcccctgcgagacaccaccattcactcgagacctcaagaaagcaatcccacctcactgctgcaaacgctccatcccacgctccttctcctacctcctcttcgacatcctcgtctcctcctccctctaccacctctccacagcctacttccctcccctcccccaccctctcccttacctcgcctggcccctctactgggcctgccaaggctgcgtcctaacgggcctctgggtcatagcccacgagtgcggccaccacgccttcagcgactac

SEQ ID NO: 38304 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcggcggagacctcaagaaagcaatcccacctcactgcttcaaacgctccatccctcgctccttctcctacctcctcttcgacatcatcatctcctcctcggctcctccctctaccacctctccacagcctacttccctctcacttacctcgcctgacccctctactgggcctgccaaggctgcgtcctaacgggcctctgggtcatagcccacgagtgcggccaccacgccttcagcgactac

SEQ ID NO: 38305 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38306 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38307 - DNA, 316 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 38308 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcaactac

SEQ ID NO: 38309 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38310 - DNA, 401 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttggccaccacctgctgaggggtcaagccgtgggcctggcacagcaccggcaacagccgctggaggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38311 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagcctgaaaccgacaccatcaaacgcgtaccctgcgagacaccgcccttcactgtagaactcaagaaaacaatcccaccgcactgcttcaaacgctccatccctcgctccttctcctaccacctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38312 - DNA, 404 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccacccttcactctcggagcaggtggtggccatcgccagcaatattggtggcaagcaggcgctggagacggtgcgagacctcaagaaagcaatcccacctcactgcttcaaacgctccatccctcgctccttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38313 - DNA, 292 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 38314 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctccttctccctctaccacctctccacagcctacttccctctcctcccccaccctctcccttacctcgcctggcccctctactgggcctgccaaggctgcgtcctaacgggcctctgggtcatagcccacgaatgcggccaccacgccttcagcgactac

SEQ ID NO: 38315 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcggcttcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38316 - DNA, 291 bp, Artificial
  Mutation in BnaC.FAD2.b introduced by TALE nuclease pair BnFAD2_T03
caggatccatgggtgcaggtggaagaatgcgagtgtctcctccctccagctcccccgaaaccaaacccctcaaacgcaatcccacctcactgcttcaaacgctccatccctcgctccttctcctacctcctcttcgacatcctcgtctcctcctccctctaccacctctccacagcctacttccctctcccttccctcgcctgacccctctactgggcctgccaaggctgcgtcctaacgggcctctgggtcatagcccacgagtgcggccaccacgccttcagcgactac

SEQ ID NO: 38317 - DNA, 368 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagcaatggcggtggctggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38318 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccagcacgccggcagggactag

SEQ ID NO: 38319 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 38320 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacattaggccgcaagaaagcaatcccacctcactgctgcaaacgctccatcccacgctccttctcctacctcctcttcgacatcatcgtctcctcctccctctaccacctcgccaccgcctacttccctctcctcccccaccctctcccttacctcgcctggccgctctacggggcctgccagggctgcgtcctaacgggcctctgggtcatagcccacgagtgcggccaccacgccttcagcgactac

SEQ ID NO: 38321 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccaccgcactgtttcaaacgctcgatccctcgctctttctcctacctcatctgggacatcatcatagcctcctgcttctactacgtcgccaccacttacttccctctcctcccccaccctctcccttaccgcgcctggcccctctactgggcctgccaaggctgcgtcctaacgggcctctgggtcatagcccacgagtgcggccaccacgccttcagcgactac

SEQ ID NO: 38322 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcaacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38323 - DNA, 301 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaagaaagcaatcccacctcactgcttcaaacgctccatcccacgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38324 - DNA, 406 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtccgactgggcctttcgttttatctgttgtttgtcggtgaacgctctcctgagtaggagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38325 - DNA, 361 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacggtccagcggctgttgccggtgctgtgccaggcccacggcttgaccccggagcaggtggtggccagacctcaagaaagcaatcccacctcactgcttcaaacgctccatcccacgctccttctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38326 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgctagacaccacccttcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38327 - DNA, 293 bp, Artificial
  Mutation in BnaC.FAD2.b introduced by TALE nuclease pair BnFAD2_T03
caggatccatgggtgcaggtggtggccatcgccagccacgattgctgcaacagccgctggaccgagacctcaagaaagcaatcccacctcactgcttcaaacgctccatccctctctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgagtgcggcccccacgccttcagcgactac

SEQ ID NO: 38328 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctcttcgacatcatcatctcctcctcggctcctccctctaccacctctccacagcctagttccctctcccttacctcgcctgacccctctactgggcctgccaaggctgcgtcctaacgggcctctgggtcatagcccacgagtgcggccaccacgccttcagcgactac

SEQ ID NO: 38329 - DNA, 303 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38330 - DNA, 257 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38331 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaccgagacctcaagaaagcaatcccacctcactgcttcaaacactccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38332 - DNA, 336 bp, Artificial
  Mutation in BnaC.FAD2.b introduced by TALE nuclease pair BnFAD2_T03
caggatccatgggcgcaggtggaagaatgcaagtctctcctccctccagctcccccggaaccaaaaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38333 - DNA, 349 bp, Artificial
  Mutation in BnaC.FAD2.b introduced by TALE nuclease pair BnFAD2_T03
caggatccatgggtgcaggtggaagaatgcaagtatctcctccctccagctcccccgaaaccaaaaccctcaaacgcgtcccctgcgagacaccacccttcactaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccgcgaatgcgtccaccacgccttcagcgactac

SEQ ID NO: 38334 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgtagaactcaagaaagcaatcccaccgcactgtttcaaacgctcgatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgagtgcggccaccacgccttcagcgactac

SEQ ID NO: 38335 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38336 - DNA, 335 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 38337 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcagacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38338 - DNA, 339 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccaagggtgcgtcctaaccggcgtctgggtcatagcccacgaatgcggccaccacgccttcagcgactac

SEQ ID NO: 38339 - DNA, 334 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccatggctgcgtcctaacgcgcctctgggtcatcgcccacgaatgcggccaccacgccatcagcaactac

SEQ ID NO: 38340 - DNA, 336 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38341 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaacgggcctctgggtcatcgcccacgaatgcggccaccacgccttcagcgactac

SEQ ID NO: 38342 - DNA, 329 bp, Artificial
  Mutation in BnaC.FAD2.b introduced by TALE nuclease pair BnFAD2_T03
caggatccatgggtgcagttggaagaatgcaagtctctcctccctccagctccaccggaaccaacaccctcaaacgcgtcccctgcgagacaccaccagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaactggcctctgggtcatagcccacgagtgcggccaccacgccatcagcgactac

SEQ ID NO: 38343 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcatgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggccggccaaggctgcgtcctaacgggcctctgggtcatcgcccacgaaggcggccaccacgccttcagcgactac

SEQ ID NO: 38344 - DNA, 308 bp, Artificial
  Mutation in BnaC.FAD2.b introduced by TALE nuclease pair BnFAD2_T03
caggatccatgggtgcaggtggaagaatgcaagtgtctcctccctccaaaaagtccgaaaccgacaacatcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38345 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgtagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38346 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaggcgctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38347 - DNA, 265 bp, Artificial
  Mutation in BnaC.FAD2.b introduced by TALE nuclease pair BnFAD2_T03
caggatccatgggtgcaggtggcagaatgcaagtctctcctccctccagtctctccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38348 - DNA, 359 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38349 - DNA, 336 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactggagaactcaagaaagcaatcccacctcactgcttcaaacgctccatcccacgctccttctcctcttcgccaccatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccgtcagcgactac

SEQ ID NO: 38350 - DNA, 366 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactatcaggggataacgcaggaaagaacatgtgagcaaaaggccagcaaatctaccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 38351 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38352 - DNA, 346 bp, Artificial
  Mutation in BnaC.FAD2.b introduced by TALE nuclease pair BnFAD2_T03
caggatccatgggtgcaggtggaagaatgcaagtctctcctccttccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 38353 - DNA, 396 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagttgccggtgctgtgccaggcccacggcttgaccccccagcaggtggtggccatcgccagcagacctcaagaaagcaatcccacctcactgcttcaaacgctccatcccacgctccttctcctcttcgacatcatcatctcctcctcggctcctccctctcccacctctccccagcctacttccctctcccttacctcgcctggtccctctactgggcctgccaaggctgcgtcctaacgggcctctgggtcatcgcccacgaatgcggccaccacgccttcagcgactac

SEQ ID NO: 38354 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatccatcgctccttctcctacctcctcttcgacatcctagtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38355 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38356 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaacaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38357 - DNA, 332 bp, Artificial
  Mutation in BnaC.FAD2.b introduced by TALE nuclease pair BnFAD2_T03
caggatccatgggtgcaggtggcagaatgcaagtctctcctccctccaagaagtctgaaaccgacaccatcaagcgcgtaccctgcgagacaccgcccttcacttcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38358 - DNA, 351 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 38359 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38360 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctctttgacatcctcgtctcctcctccctctaccacctctccacagcctacttccctctcctcccccaccccctcccttacctcgcctggcccctctaccgggcctgccaaggctgcgtcctaacgggcctctgggtcatcgcccaccaatgcggccaccacgccttcagcgactac

SEQ ID NO: 38361 - DNA, 311 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcactgcttcaaacgctccattccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38362 - DNA, 347 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccaccattcactctcgggagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38363 - DNA, 468 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactctataaggcttgatgaaacaacgcggcgagccccatgaccaaaatcccttaacgtgagttacgctctgtgccaggcccacggcttgaccccggagcaggtggtggccatcgccagccacgatggcggcaagcagagacctcaagaaagcagtcccaccccactgcttcaaacgctccatcccacgctccgtctcctcttcgacatcatgagctcctcctcggctcctccctctgccacctctccacagcctacttccctctcccttacctcgcctgacccctctactgggccggccaagggtgcgtcctaacgggcctctgggtcatcgcccacgaatgcggccaccacgccttcagcgactac

SEQ ID NO: 38364 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgtggccaccacgccttcagcgactac

SEQ ID NO: 38365 - DNA, 333 bp, Artificial
  Mutation in BnaC.FAD2.b introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38366 - DNA, 334 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactc

SEQ ID NO: 38367 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38368 - DNA, 350 bp, Artificial
  Mutation in BnaC.FAD2.b introduced by TALE nuclease pair BnFAD2_T03
caggatccatgtgtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38369 - DNA, 349 bp, Artificial
  Mutation in BnaC.FAD2.b introduced by TALE nuclease pair BnFAD2_T03
caggatccatgggtgcaggtggcagaatgcaagtctctcatacctcccgctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaattcggccaccacgccttcagcgactac

SEQ ID NO: 38370 - DNA, 279 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactcttcgacatcctcgtctcctcctccctctaccacctctccacagcctacttccctctcctccaccaccctctcccttacctcgcctggcccctctactgggcctgccaaggctgcgtcctaacgggcctctgggtcatagcccacgagtgcggccaccacgccttcagcgactac

SEQ ID NO: 38371 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38372 - DNA, 356 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaatggcaagcaggcgctggagacggagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38373 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 38374 - DNA, 337 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38375 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38376 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 38377 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 38378 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38379 - DNA, 317 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38380 - DNA, 335 bp, Artificial
  Mutation in BnaC.FAD2.b introduced by TALE nuclease pair BnFAD2_T03
caggatccatgggtgcaggtggaagaatgcaagtgactcctccctccaagaagtctgaaaccgacaccatcaagcgcgtaccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38381 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcggagacctcaagaaagcaatcccacctcactgcttcaaacgctccatccctcgctccttctcctacctcctcttcgacatcctcgtctcctcctccctctaccacctctccacagcctacttccctcccctcccccaccctctcccttacctcgcctggcccctctactgggcctgccaaggctgcgtcctaacgggcctctgggtcatcgcccacgaatgcggccaccacgccttcagcgactac

SEQ ID NO: 38382 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38383 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 38384 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 38385 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 38386 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcaacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 38387 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38388 - DNA, 335 bp, Artificial
  Mutation in BnaC.FAD2.b introduced by TALE nuclease pair BnFAD2_T03
caggatccatgggtgcagggggaagaatgcaagtgtctcctccctccaagaagtctgaaaccgacaccatcaagcgcgtaccctgcgagacaccgcccttcactggagaactcaagaaagcaatcccacctcactgctccaaacgctccatccctcgctccttctcctacctcctcttcgacatcctcgtctcctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 38389 - DNA, 334 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccacccttcactctacctcaagaaagcaatcccacctcactgcttcaaacgctccatcccacgctccttctcctcttcgacatcatcatctcctcctcggctcctccctctaacacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38390 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38391 - DNA, 336 bp, Artificial
  Mutation in BnaC.FAD2.b introduced by TALE nuclease pair BnFAD2_T03
caggatccatgggtgcaggtggaagaatgcaagtgcctcctccctccaaaaagtctgaaaccgacaacatcaagcgcgtaccctgcgagacaccaccattcactcgagacctcaagaaagcaatcccacctcactgcttcaaacgctccatcccacgctccttctcctcttcgacatcatcatctcctcctcgactcctccctctaccacctctccacagcctacttccctctcccttacctcgcctgacccctctactggtcctgccaaggctgcgtcctaacgggcctctgggtcatagcccacgagtgcggccaccacgccttcagcgactac

SEQ ID NO: 38392 - DNA, 336 bp, Artificial
  Mutation in BnaC.FAD2.b introduced by TALE nuclease pair BnFAD2_T03
caggatccatgggtgcaggtgcaagaatgcaagtctctactcaatccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcttctgggtcatagcccacgagtgcgtccaccacgcctgcatcgactac

SEQ ID NO: 38393 - DNA, 439 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagcgcctgcttgccaccgccattgctggcgatggccaccacctgctccggggtcaagccgtgggcctggcacagcaccggcaacagccgctgacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtaatagcccacgagtgcggccaccacgccttcagcgactac

SEQ ID NO: 38394 - DNA, 351 bp, Artificial
  Mutation in BnaC.FAD2.b introduced by TALE nuclease pair BnFAD2_T03
caggatccatgggtgcaggtggaagaatgcaagtgtcccctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38395 - DNA, 329 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 38396 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaaacaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38397 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccgacaccatcaagcgcgtaccctgcgagacaccgcccttcactgtaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38398 - DNA, 306 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 38399 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcctcgtctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38400 - DNA, 392 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgacgctcaagtcagaggtggcgaaacccgacaggactataaagataccaggcgttagacctcaagaaagcaatcccacctcactgcttcaaacgctccatcccacgctccttctcctcttcgacatcatcatctcctcctcggctcctccctctaccacctctccccagcctacttccctctcccttacctcgcctgacccctctactgggcctgccaaggctgcgtcctaacgggcctctgggtcatagcccacgagtgcggccaccacgccttcagcgactac

SEQ ID NO: 38401 - DNA, 350 bp, Artificial
  Mutation in BnaC.FAD2.b introduced by TALE nuclease pair BnFAD2_T03
caggatccatgggtgcaggtggaagaatgtaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38402 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgccccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 38403 - DNA, 464 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacaccacctgctccggggtcaagccgtggacctggcacagcaccggcaacagcgcctgcaccgtctccagcgcctgcttgccaccaatattgctggcgatggccaccacctgctccggagacctcaagaaagcaatcccacctcactgcttcaaacgctccatcccacgctccttcccctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38404 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38405 - DNA, 364 bp, Artificial
  Mutation in BnaC.FAD2.b introduced by TALE nuclease pair BnFAD2_T03
caaggatccatgggtgcaggtggaagaatgcaagtctctcctccctccagctcccccggaaccaacaccctcaaacgcgtcccctgcgagacaccaccattcactctgcgatggcggcaagcaggcgctggagaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38406 - DNA, 266 bp, Artificial
  Mutation in BnaC.FAD2.b introduced by TALE nuclease pair BnFAD2_T03
caggatccatgggtgcaggtggaagaatgcaagtctcgacctcaagaaagcaatcccacctcactgcttcaaacgctccatcccacgctccttctcctcttcgacatcatcatctcctcctcggctccttcctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 38407 - DNA, 337 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38408 - DNA, 293 bp, Artificial
  Mutation in BnaC.FAD2.b introduced by TALE nuclease pair BnFAD2_T03
caggatccatgggtgcaggtggcagaatgcaagtgtctcctccctccaagaagtctgaaaccgtcaacatcaagaaagcaatcccaccgcactgtttcaaacgctcgatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38409 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38410 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38411 - DNA, 346 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaacaccctcaaccgcgtcccctgcgagacaccacccttcactacctcaagaaagcaatcccacctcactcctcaaaacgctccatccctcgctccttctcctacctcctcttcgacatcctcgtctcctcctccctctaccacctctccccagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38412 - DNA, 404 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagccgaacgaccgagcgcagcgagtcagtgagcgaggaagcggaagagcgcccaatacgcggagacctcaagaaagcaatcccacctcactgcttcaaacgctccatcccacgctccttctcctcttcgacatcatcatagcctcctgcttctactacgtcgccacctcttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 38413 - DNA, 305 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38414 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatctcccacgaatgcgtccaccacgccttcagcgactac

SEQ ID NO: 38415 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctactcccccaccctctcccttacctcgcctggcccatctactgggcctgccaagggtgcgtcctaaccggcgtctgggtcatagcccacgagtgcggccaccacgccttcagcgactac

SEQ ID NO: 38416 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcggaccacaaccaagcaatcccacctccctccttcaaacgatccctccctcccgccttctcctccccctccttcgacctccccgccccctcctccctctaccacctctccacatcctacttccctctcctccctcaccctctctcctacctcgcctggcctctctactgggcctgccaagggtgcgtcctaaccggcgtctgggtcatagcccacgagtgcggccaccacgccttcagcgactac

SEQ ID NO: 38417 - DNA, 321 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccacctcactgcttcaaacgctccatcccacgctccttctcctacctcctcttcgacatcctcgtctcctcctccctctaccacctctccacagcctacttccctctcccttacctcgcctggcctctctactgggcctgccaaggctgcgtcctaaccggcgtctgggtcatagcccacgagtgcggccaccacgccttcagcgactac

SEQ ID NO: 38418 - DNA, 332 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38419 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgtcaaggctgcgtcctaacgggcctctgggtcatcgcccacgaatgcggccaccacgccttcagcgactac

SEQ ID NO: 38420 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgcgagacaccacccttcactctagacctcaagaaagcaatcccacctcactgcttcaaacgctccatccctcgcgccttctcctacctcctcttcgacatccccgtctcctcctccctctaccacctctccacagcctacttccctctcctccccctccctctcccttacctcgcctggcccctctactgggcctgccaaggctgcgtcctaacgggcctctgggtcatcgcccacgaatgcggccaccacgccttcagcgactac

SEQ ID NO: 38421 - DNA, 400 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctggcaacgctgcgatcatgtcctgatacttgacagcgacggtccctttcgcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38422 - DNA, 310 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcactgcttcaaacgctccatcccacgctccttctcctacctcctcttcgacatcctcgtctcctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 38423 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38424 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttgcctcgcctggcccctctactgggcctgccaaggcggcgtcctaacgggcctctgggtcatagcccacgagtgcggccaccacgccttcagcgactac

SEQ ID NO: 38425 - DNA, 319 bp, Artificial
  Mutation in BnaC.FAD2.b introduced by TALE nuclease pair BnFAD2_T03
caggatccatgggtgcaggtggcagaatgcaagtctctactccctccagctcccccggaaccaacaccctcaaacgcgtcccctgcgagacaccacaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtccgaacgggcctctgggtcatagcccacgagtgcggccaccacgccttcagcgactac

SEQ ID NO: 38426 - DNA, 330 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38427 - DNA, 332 bp, Artificial
  Mutation in BnaC.FAD2.b introduced by TALE nuclease pair BnFAD2_T03
caggatccatgggtgcaggtggaagaatgcaagtgtctcctccctccaaaaagcctgaaaccgacaacatcaagcgcgtaccctgcgagacaccaccattcactctagacctcaagaacgcaatcccccctcactgcttcaaccgctccaccccccgctccttctcctcttccacctcatcctctcctcctcgcctcctccctctaccacctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38428 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38429 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 38430 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38431 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38432 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtccgaacgggcctctgggtcatagcccacgagtgcggccaccacgccttcagcgactac

SEQ ID NO: 38433 - DNA, 342 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38434 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccaccctccttctcctcttcgcaatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 38435 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38436 - DNA, 344 bp, Artificial
  Mutation in BnaC.FAD2.b introduced by TALE nuclease pair BnFAD2_T03
caggatccatgggtgcaggtggcagaatgcaagtctctcatccctccagctcccccgaaaccaaaaccctcaaacgcgtcccctgcgagacaccacccttagacctcaagaaagcaatcccacctcactgcttcaaacgctccatccctcgctccttctcctacctcctcttcgacatcctcgtctcctcctccctctaccacctctccacagcctacttccctctcatcccccaccctctcccttacctcgcctggcccctctactgggcctgccaaggctgcgtcctaacgggcctctgggtcatcgcccacgaatgcggccaccacgccttcagcgactac

SEQ ID NO: 38437 - DNA, 331 bp, Artificial
  Mutation in BnaC.FAD2.b introduced by TALE nuclease pair BnFAD2_T03
caggatccatgggtgcaggtggaagaatgcaagtctctcctcactccagctcccccggaaccaacaccctcaaacgcgtcccctgcgagacaccaccattcactcttacagcgagcgatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtcctaacgtgcctctgggtcatagcccacgagggcggccaccacgccttcagcgactac

SEQ ID NO: 38438 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38439 - DNA, 348 bp, Artificial
  Mutation in BnaC.FAD2.b introduced by TALE nuclease pair BnFAD2_T03
caggatccatgggtgcaggtggaagaatgcaagtgtctactccctccaagaagtctgaaaccgacaccatcaaacgcgtcccctgcgagacaccacccttcactgaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaacgggcctctgggtcatagcccacgagtgcggccaccacgccttcagcgactac

SEQ ID NO: 38440 - DNA, 447 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctaggcgccttatccggtaactatcgtcttgagtccaacccggtaagacacgacttatcgccactggcagcagccactggtaacaggattagcagagcgaggtatgtagaaagcaatcccacctcactgcttcaaacgctccatccctcgctcctcctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 38441 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38442 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38443 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcatcgactac

SEQ ID NO: 38444 - DNA, 272 bp, Artificial
  Mutation in BnaC.FAD2.b introduced by TALE nuclease pair BnFAD2_T03
caggatccatgggtgcaggtggaagaatgcaagtctctcctccctccagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38445 - DNA, 349 bp, Artificial
  Mutation in BnaC.FAD2.b introduced by TALE nuclease pair BnFAD2_T03
caggatccattggtgcaggtgcaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38446 - DNA, 336 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgctgccaccacgccatcagcgactac

SEQ ID NO: 38447 - DNA, 297 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaacgcgtcccctgcgagacaccacaagaaagcaatcccacctcactgcttcaaacgctccatcccacgctccttctcctcttcgacatcatcatctcctcctcggctcctccctcaccctctctcctacttcgcctggcctctctactgggcctgccagggctgcgtcctaaccggcgtctgggtcatagcccacgagtgcggccaccacgccttcagcgactac

SEQ ID NO: 38448 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 38449 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgtagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccatgagtgcggccaccacgccttcagcgactac

SEQ ID NO: 38450 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38451 - DNA, 348 bp, Artificial
  Mutation in BnaC.FAD2.b introduced by TALE nuclease pair BnFAD2_T03
caggatccatgggtgcaggtggaagaatgcaagtctctcctccctccggctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38452 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38453 - DNA, 301 bp, Artificial
  Mutation in BnaC.FAD2.b introduced by TALE nuclease pair BnFAD2_T03
caggatccatgggtgcaggaggaagaatgcaagtgcctcctccctccaagaagtctgaaaccgacaccatcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38454 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38455 - DNA, 351 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaacatcaagcgcgtaccctgcgagacaccgcccttcactgtgagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38456 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcagacctcaagaaagcaatcccacctcactgcttcaaacgctccatcccaccctccttctcctcttcgtcctcatcatctcctcctcggctcctccctctaccacctctccacatcctacttccctctcctccccccccctctcccttacctcgcctggcccctctactgggcctgccaaggctgcgtcctaacgggcctctgggtcatagcccacgagtgcggccaccacgccttcagcgactac

SEQ ID NO: 38457 - DNA, 344 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccaccattcactctcagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgtccacgaatgcggccaccacgccttcagcgactac

SEQ ID NO: 38458 - DNA, 399 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccataccggccaccacctgctggggggtcaagccgtgggcctggcacagcaccggcaacagccgctggaccggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 38459 - DNA, 340 bp, Artificial
  Mutation in BnaC.FAD2.b introduced by TALE nuclease pair BnFAD2_T03
caggatccatgggtgcaggtggaagaatgcaagtctctcctccctccagcacccccggaaccaacaccctcaaacgcgtcccctagcagacgccggagacctcaagaaagcaatcccacctcactgtttcaaacgctccatcccacgctccttctcctacctcctcttcgacatcctcgtcgcctcctccctctaccacctcgccacaacctacttccctctcctccctcaccctctcccctacctcgcctggcccctctactgggcctgccaaggctgcgtcctaacgggcctctgggtcatcgcccacgaatgtggccaccacgccttcagcgactac

SEQ ID NO: 38460 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggccggccaaggctgcgtcctaacgggcctctgggtcatcgcccacgaatgcggccaccacgccatcagcgactac

SEQ ID NO: 38461 - DNA, 432 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcctggagacggtccagcggctgttgccggtgctgtgccaggcccacggcttgaccccggagcagggggtggccatcgccagccacgatggcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38462 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgactcctctactgggcctgccaaggctgcgtcctaacgggcctctgggtcatcgcccacgaatgcggccaccacgccttcagcgactac

SEQ ID NO: 38463 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcggcctaacgggcctctgggtcatagcccacgagtgcggccaccacgccttcagcgactac

SEQ ID NO: 38464 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 38465 - DNA, 335 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 38466 - DNA, 349 bp, Artificial
  Mutation in BnaC.FAD2.b introduced by TALE nuclease pair BnFAD2_T03
caggatccatgggtgcatgtggaagaatgcaagtctctcctccctccagctcccccggaaccaacaccctcaaacgcgtcccctgcgagacaccaccattcactcagacctcaagaaagcaatcccccctcactgcttcaaacgctccatccctcgctccttctcctacctcctcttcgacatcctcgtctcctcctccctctaccacctctccacagcctacttccctctcctcccccaccctctcccttgcctcgcctggcccctctactgggcctgccaaggctgcgtcctaacgggcctctgggtcatcgcccgcgaatgcggccaccgcgccttcaacgactac

SEQ ID NO: 38467 - DNA, 335 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38468 - DNA, 293 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacactggagacggtctcgatccctcgctctttctcctacctcatctgggacatcatcatagcctcctgcttctactacgtcgccaccacttacttccctctcccttacctcgcctgacccctctactgggcctgccaaggctgcgtcctaacgggcctctgggtcatagcccactagtgcggccaccacgccttcagcgactac

SEQ ID NO: 38469 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactccggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38470 - DNA, 347 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38471 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38472 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38473 - DNA, 347 bp, Artificial
  Mutation in BnaC.FAD2.b introduced by TALE nuclease pair BnFAD2_T03
caggatccacgggtgcaggtggcagaatgcaagtctctcctccctccagctcccccggaaccaacaccctcaaacgcgtcccctgcgagacaccaccattcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38474 - DNA, 391 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccaccattcacttccgtgggcctggcacagcaccggcaacagccgctggagacgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38475 - DNA, 460 bp, Artificial
  Mutation in BnaC.FAD2.b introduced by TALE nuclease pair BnFAD2_T03
caggatccatgggtgcaggtggaagaatgcaagtctctcctccctccagctcccggcggatttgtcctactcaggagagcgttcaccgacaaacaacagaggcgctgttgccggtgctgtgccaggcccacggcttgaccccccagcaggtggtggccatcgccagcaataatggtggcaacagccgctggagagtgaatggtggtgtctcgcaggggacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacggtcctctgggtcatcgcccacgaatgcggccaccacgccttcagcgactac

SEQ ID NO: 38476 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcgacctcaagaaagcaatcccacctcactgcttcaaacgctccatcccacgctccttctcctcttcgacatcatcatctcctcctcggctcctccctctaccacctctccacagcctacttacctctcccttacctcgcctgacccctctactgggcctgccaaggctgcgtcctaacgggcctctgggtcatagcccacgagtgcggccaccacgccttcagcgactac

SEQ ID NO: 38477 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgtttcatcgcccacgaatgcggccaccacgcattcagcgactac

SEQ ID NO: 38478 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38479 - DNA, 308 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38480 - DNA, 398 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccataccggccaccacctgctggggggtcaagccgtgggcctggcacagcaccggcaacagccgctggaccggagacctcaagaaagcaatcccacctcactgcttcaaacgctccatccctcgctccttctcctacctcctcttcgacatcctcgtctcctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38481 - DNA, 347 bp, Artificial
  Mutation in BnaC.FAD2.b introduced by TALE nuclease pair BnFAD2_T03
caggatccatgggtgcaggtggaagaatgcaagtctctcatccctccagctcccccgaaaccaaaaccctcaaacgcgtcccctgcgagacaccacccttcactctcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38482 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcagacctcaagaaagcaatcccacctcactgcttcaaacgctccatccctcgctccttctcctacctcctcttcgacctcctcgtctccgcctccctctaccacctctccacctcctccttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 38483 - DNA, 409 bp, Artificial
  Mutation in BnaC.FAD2.b introduced by TALE nuclease pair BnFAD2_T03
caggatccatgggtgcaggtggaagaatgcaagtgtctcctccctccaaaaagcctgaaaccgacaacatcaagcgcgtaccctgcgagacaccgcccttcactgttgcactgacgggtgccccgctcaacttgaccccccagcaggtggtggccatcgccagcaataatggtggcaagcaatcccacctcactgcttcaaacgctccatccctcgctccttctcctacctccccttcgacatcctcgtctcctcctccctctaccacctctccacagcctgcttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38484 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctaccgggcctgccaaggctgcgtcctaacgggcctctgggtcatagcccacgagtgcggccaccacgccttcagcgactac

SEQ ID NO: 38485 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagcctgaaaccgacaccatcaagcgcgtaccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38486 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccagggctgcgtcctaaccggcgtctgggtcatagcccacgagtgcggccaccacgccttcagcgactac

SEQ ID NO: 38487 - DNA, 267 bp, Artificial
  Mutation in BnaC.FAD2.b introduced by TALE nuclease pair BnFAD2_T03
caggatccatgggtgcaggtggaagaatgcaagtctctagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38488 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaacgggcctctgggtcatagccctcgagggcggccaccacgccttcagccactac

SEQ ID NO: 38489 - DNA, 343 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttttgttagaactcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38490 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 38491 - DNA, 346 bp, Artificial
  Mutation in BnaC.FAD2.b introduced by TALE nuclease pair BnFAD2_T03
caggatccatgggtgcaggtggaagaatgcaagtacctcctccctccagctcccccggaaccaacaccctcaaacgcgtcccctgcgagacaccaccattcactctcaggcgctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38492 - DNA, 393 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcggcctttttacggttcctggccttttgctggccttttgctcacatgttctttcctgcgttatcccccgggagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38493 - DNA, 385 bp, Artificial
  Mutation in BnaC.FAD2.b introduced by TALE nuclease pair BnFAD2_T03
caggatccatgggtgcaggtggcagaatgcaagtctctcctccatccagctcccccgaaaccaaaaccctcaaacgcgtcccctgcgagacaccacccttcactgtcgggtcagggtgccggccttgatcatctcgccgccagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38494 - DNA, 380 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctcggtgccaggcccacggcttgaccccccagcaggtggtggccagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38495 - DNA, 350 bp, Artificial
  Mutation in BnaC.FAD2.b introduced by TALE nuclease pair BnFAD2_T03
caggattcatgggtgcaggtggaagaatgcaagtctctcctccctccagctcccccgaaaccaaaaccctcaaacgcgtcccctgcgagacaccacccttcactcgagacctcaagaaagtaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38496 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtaccctgcgagacaccgcccgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38497 - DNA, 331 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactcttacagcgagcgatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38498 - DNA, 350 bp, Artificial
  Mutation in BnaC.FAD2.b introduced by TALE nuclease pair BnFAD2_T03
caggatccatgggtgcaggtggaagaatgcaagtctctcctccctccaaaaagtctgaaaccgacaacatcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38499 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaacccaaaaccctcaaacccgtcccctccgagacccccccctccactcagacctcaagaaagcaatcccacctcactgcttcaaccgctccatccctcgctccttctcctacctccccttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38500 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccaccgcactgtttccaacgctcgatccctcgctccttctcctacctcctcttcgccatcctcgtctcctcctccctctaccacctctccacagcctacttccctctcccttacctcgcctggcccctctactgggcctgccagggctgcgtcctaaccggcgtctgggtcatagcccacgagtgcggccaccacgccttcagcgactac

SEQ ID NO: 38501 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 38502 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggagacctcaagaaagcaatcccacctcactgcttcaaacgctccatcccacgctccttctcctcttcgacatcatcatctcctcctcgactcctccctctaccacctctccacagcctacttccctctcccttacctcgcctggcccctctactgggcctgccaagggtgcgtcctaaccggcgtctgggtcatagcccacgagtgcggccaccacgccttcagcgactac

SEQ ID NO: 38503 - DNA, 370 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcatcccctgcgagacaccaccattcactctcggtggataaccgtattaccgcctttgagtgagctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38504 - DNA, 339 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgggaagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38505 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 38506 - DNA, 399 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccataccggccaccacctgctggggggtcaagccgtgggcctggcacagcaccggcaacagccgctggaccggagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38507 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38508 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacactcaaacgcgtcccctgcgagacaccaccattcactccatcccacgctccttctcaagaaagcaatcccacctcactgcttcaaacgctccatcccacgctccttctcctcttcgacatcatcatctcctcctcggctcctccctctaccacctctccacagcctacttccctctcccttacctcccctgaccccgccactgggcctgccaaggctgcgtcctaacgggcctctgggtcatagcccacgagtgcggccaccacgccttcagcgactac

SEQ ID NO: 38509 - DNA, 369 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacggtccagcggctgttgccggtgctgtgccaggcccacggcttgaccccggagcaggtggtggccagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38510 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38511 - DNA, 335 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgcctgcagcgactac

SEQ ID NO: 38512 - DNA, 364 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtccccacgcgtcccagcaatggcggtggcaagcaggcgctggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38513 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaacgggcctctgggtcatcgcccacgaatgcggccaccacgccttcagcgactac

SEQ ID NO: 38514 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgcctcaagaaagcaatcccacctcactgcttcaaacgctccatccctcgctccttctcctacctcctcttcgacatcctcgtctcctcctccctctaccacctctccaccgcctacttccctctccccccccaccctctcccttacctcgcctggcccctctactgggcctgccaaggctgcgtcctaacgggcctctgggtcatcgcccacgaatgcggccaccacgccttcagcgactac

SEQ ID NO: 38515 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgacctcaagaaagcaatcccacctcactgcttcaaacgctccatcccacgctcctctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38516 - DNA, 425 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggtctttcggctgcggcgagcggtatcagctcactcaaaggcggtaatacggttatcacctgtcgcaaatatagtaaaacacttatagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38517 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagaaagcaatcccacctcactgcttcaaacgctccatccctcgctccttctcctatctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 38518 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgtgcctctgggtcatcgcccacgaatgcggccaccacgccttcagcgactac

SEQ ID NO: 38519 - DNA, 342 bp, Artificial
  Mutation in BnaC.FAD2.b introduced by TALE nuclease pair BnFAD2_T03
caggatccatgggtgcaggtggaagaatgcaagtgtctcatccctccaaaaagtctgaaaccgacaacatcaagcgcgtaccctgcgagacaccgcccttaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38520 - DNA, 342 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38521 - DNA, 391 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccagcgcctgcttgccaccattattgctggcgatggccaccacctgctggggggtcaagttgagcggggcacccgtcagtgcattgcgccagagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38522 - DNA, 372 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggtttcccgactggaaagcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38523 - DNA, 322 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38524 - DNA, 336 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38525 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgagtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38526 - DNA, 328 bp, Artificial
  Mutation in BnaC.FAD2.b introduced by TALE nuclease pair BnFAD2_T03
caggatccatgggtgcaggtggcagaatgcaagtgtctactccctccaaaaagtctgaaaccgacaacatcaagcgcgtaccctgcgagacaccgcccttcactgttagaaagcaatcccaccgcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagccaacgagtgcggccaccacgccttcagcgactac

SEQ ID NO: 38527 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacactctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagccgacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38528 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatccaacctcactgcttcaaacgctccatcccaccctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38529 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 38530 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttctacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38531 - DNA, 378 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgcctgcttgccaccgccattgctggcgatggccaccacctttgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggtcaccacgccttcagcgactac

SEQ ID NO: 38532 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38533 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccataaagcgcgtaccctgcgagacaccgcccttcactgtagaactcaagaaagcaatcccacctcactgcttcaaacgctccatccctcgctccttctcctacctcctcttcgacatcctcgtctcctcctccctctaccacctctccacagcctacttccctctcctcccccaccctctccctttcctcgcctgacccctctactgggcctgccaaggctgcgtcctaacgggcctctgggtcatagcccacgagtgcgtccaccacgccttcagcgactac

SEQ ID NO: 38534 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccacccttcactcgcacctcaagaaagcaatcccaccgcactgcttctaacgcaccatccctcgctccttctcctacctcctcttcgacatcctcctcccctcctccctctaccacctcgcccccccctacttccctctcctcccccaccctctcccttacctcgcctggcccctctactgggcctgccaaggctgcgtcctaaccggcctctgggtcatagcccacgagtgcggccaccacgccttcagcgactac

SEQ ID NO: 38535 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccacctcactgcttcaaacgctccatcccacgctccttctcctcttcgacttcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38536 - DNA, 348 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactctacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38537 - DNA, 378 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactgtcggctgttgccggtgctgtgccaggcccagaactcaagaaagcaatcccaccgcactgtttcaaacgctcgatccctcgctctttctcctacctcatctgggacatcatcatagcctcctgcttctactacgtcgccaccacttacttccctctccgcccccaccctctcccttacctcgcctggcccctctactgggcctgccaaggctgcgtcctaacgggcctctgggtcatcgcccacgaatgcggccaccacgccttcagcgactac

SEQ ID NO: 38538 - DNA, 433 bp, Artificial
  Mutation in BnaC.FAD2.b introduced by TALE nuclease pair BnFAD2_T03
caggatccatgggtgcaggtggaagaatgcaagtgtctcctcactccaaaaagtctgaaaccgacaacatcaagcgcgtaccctgcgagacaccgcccttcactctcagcgcctgcttgccgccatcgtggctggcgatggccaccacctgctccggggtcaagccgtgggcctggcacagcaccggcaacagccgctggacggagacctcaagaaagcaatcccacctcactgcttcaaacgctccatccctcgctccttctcctccctcctcttcgacatcctcgtctcctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38539 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 38540 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 38541 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcggcggagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38542 - DNA, 366 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactatcaggggataacgcaggaaagaacatgtgagcaaaaggccagcaaatctaccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38543 - DNA, 439 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggaccgtctcagcggctgttgccaccgccattgctggcgatggccaccacctgctggtagcggtggtttttttgtttgcaagcagcagattacgcgcagaaggagacctcaagaaagcaatcccacctcactgcttcaaacgctccatccctcgctccttctcctacctcctcttcgacatcctcgtctcctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38544 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38545 - DNA, 336 bp, Artificial
  Mutation in BnaC.FAD2.b introduced by TALE nuclease pair BnFAD2_T03
caggatccatgggtgcaggtgaaagaatgcaagtctcacctccctccagctcccccggaaccaacaccctcaaacgcgtcccctgcgagacaccaccattcactggagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcggcctgacgtgcctctgggtcatcgcccacgagtgcggccaccacgccttcagcgactac

SEQ ID NO: 38546 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38547 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 38548 - DNA, 345 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggatcggaagaactcaagaaagcaatcccacctcactgcttcaaacgctccatcccacgctccgtctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagggcggccaccacgccttcagcgactac

SEQ ID NO: 38549 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38550 - DNA, 452 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtggccatcgccagcaataatggtggcaggtggtggccatcgccagcaatggcggtggccagcaggcgctggagacggtccagcggctgttgccggtgcgagacctcaagaaagcaatccaacctcactgcttcaaacgctccagccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38551 - DNA, 371 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgccggtgctgtgccaggcccagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 38552 - DNA, 334 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38553 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctccattacctcgcctgacccctctactgggcctgccaaggctgcgtcctaacgggcctctgggtcatcgcccacgaatgcggccaccacgccttcagcgactac

SEQ ID NO: 38554 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccatgacagacctcaagaaagcaatcccacctcactgcttcaaacgctccatcccacgctccttctcctcttcgacatcatcatctcctcctcggctcctccctctaccacctctccacagcctacttccctctcccttacctcgcccgacccctctactgggcctgccaaggctgcgtcctaacgggcctctgggtcatcgcccacgaatgcggccaccacgccttcagcgactac

SEQ ID NO: 38555 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctaggcctcaagaaaacaatcccacctcactactccaaccgctccatccctcgctcctcctcctacctccccatctccatcttcgtctcctcccccctctcccacctctccacagcctacttccctctccccccccaccctctcccttacctcgcctggcccctctactgggcctgccagggctgcgtcctaaccggcgtctgggtcatcgcccacgaatgcggccaccacgccttcagcgactac

SEQ ID NO: 38556 - DNA, 349 bp, Artificial
  Mutation in BnaC.FAD2.b introduced by TALE nuclease pair BnFAD2_T03
cagatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38557 - DNA, 315 bp, Artificial
  Mutation in BnaC.FAD2.b introduced by TALE nuclease pair BnFAD2_T03
caggatccatgggtgcaggtggaagaatgcaagtctctcctccctccagctccccggaaccaacaccctcaaacgcgtcccctgcgagacaccaccattcaagaaagcaatcccacctcactgcttcaaacgctccatcccacgctccttctcctcttcgacatcatcatctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38558 - DNA, 336 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaacgcgtcccctgcgagacaccaccattcactcttgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38559 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccacccctcgctccttctcctacctcctcttcgacatcctcgtcgcctcctccctctaccacctctccacagcctacttccctctcctcccccaccctctcccctacctcgcctggcccctctactgggcctgccaaggctgcgtcctaaccggcctctgggtcatagcccacgagtgcggccaccacgccttcagcgactac

SEQ ID NO: 38560 - DNA, 337 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtcccctgcgagacaccacccttcactctgagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38561 - DNA, 383 bp, Artificial
  Mutation in BnaC.FAD2.b introduced by TALE nuclease pair BnFAD2_T03
caggagccatgagtgcaggtggaagaatgcaagtcactcctccctcaagctcccccggaaccaacaccctcaaacgcgtcccctgcgagacaacaccatcaacatcgtgaatggcgatggccaccacctgtgccaggcccacctcaagaaagcaatcccacctcactgcttcaaacgctccatcccacgctccttctcctcttcgacatcatcatctcctcctcggctcctccctctaccacctctccacagcctacttccctctccgccctcaccctctctcctccttcgcctggcctctctactgggcctgccagggctgcgtcctaacgggcctctgggtcatagcccacgagtgcggccaccacgccttcagcgactac

SEQ ID NO: 38562 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttagcgactac

SEQ ID NO: 38563 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 38564 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcgaccaccacgccttcagcgactac

SEQ ID NO: 38565 - DNA, 335 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccgcctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38566 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacatgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcccctggcccctctactgggcctgccaaggctgcgtcctaacgggcctctgggtcatcgcccacgagtgcggccaccacgccttcagcgactac

SEQ ID NO: 38567 - DNA, 286 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 38568 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 38569 - DNA, 340 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgttcggctgcggcgagcggagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38570 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccggagacctcaagaaagcaatcccacctcactgcttcaaacgctccatcccacgctccttctcctcttcgacatcatcatctcctcctcggctcctccctcaccctctctcctacttcgcctggcctctctactgggcctgccagggctgcgtcctaaccggcgtctgggtcatagcccacgagtgcggccaccacgccttcagcgactac

SEQ ID NO: 38571 - DNA, 395 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgggtcaagccgtgggcctggcacagcaccggcaacagccgctggagagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatcgcccacgaatgcggccaccacgccttcagcgactac

SEQ ID NO: 38572 - DNA, 327 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcccttacctcccctgacccctctactgggcctgccaaggctgcggcctaacgggcctctgggtcatcgcccacgaatgcggccaccacgccttcagcgactac

SEQ ID NO: 38573 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacacctcaagaaagcaatcccacctcactgcttcaaacgctccatccctcgctccttctcctacctcctcttcgacatcctcgtctcctcctccctctaccacctctccacagcctacttccctctcctccccccccctctcccttacctcgcctggcccctctactgggcctgccaaggctgcgtcctaacgggcctctgggtcatcgcccacgaatgcggccaccacgccttcagcgactac

SEQ ID NO: 38574 - DNA, 385 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcccacggcttgaccccccagcaggtggtggccatcgccagcaatggagacctcaagaaagcaatcccacctcactgcttcaaacgctccatcccacgctccttctcctcttcgacatcatcatctcctcctctgctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 38575 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccttctactgggcctgccaaggctgcgtcctaacgggcctctgggtcatagcccacgagtgcggccaccacgccttcagcgactac

SEQ ID NO: 38576 - DNA, 331 bp, Artificial
  Mutation in BnaC.FAD2.b introduced by TALE nuclease pair BnFAD2_T03
caggatccatgggtgcaggtggcagaatgcaagtctctacccccttaagctcccccgaaaacaaaaccatcaaacgcgtcccctctgagacctcaagaaagcaatcccacctcactgcttcaaacgctccatccctcgctccttcccctacctcctcttcgacatcctcatctcctcctcccgctaccacctctccacagcctacttccctctccccccccacccgctcgcctgctgcgcctggcctctctactaggcctgccaagggtgcggcctaaccggcgtctgggtcatagcccacgagtgcggccaccacgccttcagcgactac

SEQ ID NO: 38577 - DNA, 321 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctcaagaaagcaatcccacctcactgcttcaaacgctccatcccacgctccttctcctcttcgacatcctcgtctcctcctccctctaccacctctccacagcctacttccctctcccttacctcgcctgacccctctactgggcctgccaaggctgcgtcataacgggcctctgggtcatagcccacgagtgcggccaccacgccttcagcgactac

SEQ ID NO: 38578 - DNA, 351 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacccttcactctagaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38579 - DNA, 325 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaacccacaaacgcgtcccctgcgagacaccaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38580 - DNA, 335 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38581 - DNA, 311 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactaacctcaagaaagcaatcccacctcactgcttcaaacgctccatcccacgctccttctcctcttcgacatcatcatctcctcctcggctcctccctcaccctctctcctacttcgcctggcctctctactgggcctgccagggctgcgtcctaaccggcgtctgggtcatagcccacgagtgcggccaccacgccttcagcgactac

SEQ ID NO: 38582 - DNA, 335 bp, Artificial
  Mutation in BnaC.FAD2.b introduced by TALE nuclease pair BnFAD2_T03
caggatccatgggtgcagctggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcatctgggtcatagcccacgagtgcggccaccacgccttcagcgactac

SEQ ID NO: 38583 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccgacaccctcaaacgcgtcccctgcgagacaccaccatagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38584 - DNA, 334 bp, Artificial
  Mutation in BnaC.FAD2.b introduced by TALE nuclease pair BnFAD2_T03
caggatccatgggtgcagggggaagaatgcaagtctctcctccctccagctcccccggaaccaacaccctcaaacgcgtcccctgcgagacaccaccattaactagacctcaagaaagcaatcccacctcactgcttcaaacgctccatcccacgctccttctcctcttcgacatcatcatctcctcctcggctcctccctctaccacctctccacagcctacttccctctcccttacctcgcctaacccctctactgggcctgccaaggctgcgtcctaacgtgcctctgggtcatagcccacgagtgcggccaccacgccttcagcgactac

SEQ ID NO: 38585 - DNA, 333 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactcacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38586 - DNA, 347 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38587 - DNA, 302 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccagacctcaagaaagcaatcccacctcactgcttcaaacgctccatcccacgctccttctcctcttcgacatcatcatctcctcctcggctcctccctcaccctctctcctacttcgcctggcctctctactgggcctgccaagggtgcgtcctaaccggcgtctgggtcatagcccacgagtgcggccaccacgccttcagcgactac

SEQ ID NO: 38588 - DNA, 323 bp, Artificial
  Mutation in BnaC.FAD2.b introduced by TALE nuclease pair BnFAD2_T03
caggatccatgggtgcatgtggaagaatgcaagtctctcctccctccagctcccccggaaccaacaccctcaaacgcgtcccctgcgagacacctacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38589 - DNA, 347 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38590 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgcctcagcgactac

SEQ ID NO: 38591 - DNA, 345 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccatgcgagacaccaccattcacacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38592 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccatcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38593 - DNA, 336 bp, Artificial
  Mutation in BnaC.FAD2.b introduced by TALE nuclease pair BnFAD2_T03
caggatccatgggtgcaggtggcagaatgcaagtttctcctccctccagctcccccggaaccaacaccctcaaacgcgtcccctgcgagacaccaccattcactctagacctcaagacagcaatcccacctcactgcttcaaacgctccatcccacgctccttctcctcttctacatcatcatctcctcctcggctcctccctctaccacctctccacagcctacttccctctcccttacctcgcctgacccctctactgggcctgccaaggctgcgtcctaacgggcctctgggtcatagcccacgagggcggccaccacgcctgcatcgactac

SEQ ID NO: 38594 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38595 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38596 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 38597 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38598 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38599 - DNA, 360 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttttgccagcgcctaatgcgccgggagaactcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38600 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagacctcaagaaagcaatcccacctcactgcttcaaacgctccatcccaccctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38601 - DNA, 301 bp, Artificial
  Mutation in BnaC.FAD2.b introduced by TALE nuclease pair BnFAD2_T03
caggatccatgtgtgcaggtggaagaatgcaagtctctcctccctcccgtccccccggaaacaacaccctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggactgccaaggctgcgtcctaacgggcctctgggtcatagcccacgagtgcggccaccacgccttcagcgactac

SEQ ID NO: 38602 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 38603 - DNA, 412 bp, Artificial
  Mutation in BnaC.FAD2.b introduced by TALE nuclease pair BnFAD2_T03
catgatccatgggtgcaggtggaagaatgcaagtgtctcctccctccaaaaagtctgaaaccgacaacatcaagcgcgtaccctgcgagacaccacccttcactttcggggtcaagccgtgggccatcgccagccacgattgcggcaagcaggcgctggagacggtccagcggctgttgccggagacctcaagaaagcaatcccacctcactgcttcaaacgctccatccctcgctccttctcctacctcctcttcgacatcctcgtctcctcctccctctcccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 38604 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttaaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38605 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacgagacctcaagaaagcaatcccacctcactgcttcaaacgctccatcccacgctccttctcctcttcgacatcatcatctcctcctcggctcctccctctaccacttctccacagcctacttccctctcccttacctcgcctgacccctctactgggcctgccaaggctgcgtcctaacgggcctctgggtcatagcccacgagtgcggccaccacgccttcagcgactac

SEQ ID NO: 38606 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcacttcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 38607 - DNA, 357 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttttgttagaactcaagaaagcaatcccaccgcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 38608 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 38609 - DNA, 351 bp, Artificial
  Mutation in BnaC.FAD2.b introduced by TALE nuclease pair BnFAD2_T03
caggatccatgggtgcaggtggaagaatgcaagtgtctactcactccaaaaagtctgaaaccgacaacatcaagcgcgtaccctgcgagacaccgcccttcactgtgagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaacgggcctctgggtcatcgcccacgaatgcggccaccacgccttcagcgactac

SEQ ID NO: 38610 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagataccaccattcactctcagacctcaagaaagcaatcccacctcactgcttcaaacgctccatcccacgctccttctcctcttcgacatcatcatctcctcctcggctcctccctctaccacctctccacagcctacttccctctcccttccctcgcctgacccctctactgggcctgccaaggctgcgtcctaacgggcctctgggtcatagcccacgagtgcggccaccacgccttcagcgactac

SEQ ID NO: 38611 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcaagaaagcaatcccacctcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38612 - DNA, 350 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38613 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38614 - DNA, 377 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgcgatggcggcaagcaggcgctggagaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38615 - DNA, 335 bp, Artificial
  Mutation in BnaC.FAD2.b introduced by TALE nuclease pair BnFAD2_T03
caggtccatgggtgcaggtggaagaatgcaagtctctcatccctccagctcccccggaaccaacaccctcaaacgcgtcccctgcgcgacaccaccattcacatgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38616 - DNA, 336 bp, Artificial
  Mutation in BnaC.FAD2.b introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38617 - DNA, 381 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgaatgcatctagatccaatgatcatgagcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 38618 - DNA, 279 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgacta

SEQ ID NO: 38619 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 38620 - DNA, 410 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggaagaatttgtccactacgtgaaaggcctggcacagcaccggcaacagccgctggacgagacctcaagaaagcaatcccacctcactgcttcaaacgctccatccctcgctccttctcctacctcctcttcgacatcctcgtctcctcctccctctaccacctctccaccgcctacttccctctcctcccccaccctctcccttacctcgcctggcccctctactgggcctgccaaggctgcgtcctaacgggcgtctgggtcatcgcccacgaatgcggccaccacgccttcagcgactac

SEQ ID NO: 38621 - DNA, 351 bp, Artificial
  Mutation in BnaC.FAD2.b introduced by TALE nuclease pair BnFAD2_T03
caggatccatgggtgcaggtggcagaatgcaagtctctactccctccagctcccccggaaccaacaccctcaaacgcgtcccctgcgagacaccaccattcactctcagacctcaagaaagcaatcccacctcactgcttcaaacgctccatccctcgctccttctcctacctcctcttcgacatcctcgtctcctcctccctctaccacctctccacagcctacttccctctcctcccccaccctctccctgacctcgcctggcccctctactgggcctgccaaggctgcgtcctaacgggcctctgggtcatcgcccacgaatgcggccaccacgccgtcagcgactac

SEQ ID NO: 38622 - DNA, 340 bp, Artificial
  Mutation in BnaC.FAD2.b introduced by TALE nuclease pair BnFAD2_T03
caggatccatgggtgcaggtggaagaatgcaagtctctcctcactacagctccaccgaaaccaaaaccctcaaacgcgtccactgcgagacaccaccattcactcacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctcaactgggcctgccaaggctgcgtccgaacggtcctctgggtcatagcccacgagtgcggccaccacgccttcagcgactac

SEQ ID NO: 38623 - DNA, 414 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaggccgccattgctggcgatggccaccacctgctgaggggtcaagccgtgggcctggcacagcaccggcaacagccgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38624 - DNA, 345 bp, Artificial
  Mutation in BnaC.FAD2.b introduced by TALE nuclease pair BnFAD2_T03
caggatccatgggtgcaggtggcagaatgcaagtctctcctccctccaagaagtctgaaaccgacaccatcaagcgcgtaccctgcgagacaccgcccttcactactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38625 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctccccggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38626 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38627 - DNA, 440 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaccgtctccagcgcctgcttgccaccattattgctggcgatggccaccacctgctccggggtcaagccgtgggcctggcacagcaccggcaacaggcgctggagaagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38628 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcgacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcgaccaccacgccttcagcgactac

SEQ ID NO: 38629 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 38630 - DNA, 335 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38631 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38632 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacggacctctgggtcatagcccacgagtgcggccaccacgccttcagcgactac

SEQ ID NO: 38633 - DNA, 335 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 38634 - DNA, 335 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgcgagacaccaccattcactcagacttcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38635 - DNA, 348 bp, Artificial
  Mutation in BnaC.FAD2.b introduced by TALE nuclease pair BnFAD2_T03
caggatccatggtgcaggtggaagaatgcaagtctctcctccctccagctcccccgaaaccaaaaccctcaaacgcgtaccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38636 - DNA, 350 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattaactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38637 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacttggcctgccaaggctgcgtcctaacgggcctctgggtcatcgcccacgaatgcggccaccacgccttcagcgactac

SEQ ID NO: 38638 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagggcggccaccacgccttcagcgactac

SEQ ID NO: 38639 - DNA, 300 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38640 - DNA, 335 bp, Artificial
  Mutation in BnaC.FAD2.b introduced by TALE nuclease pair BnFAD2_T03
caggatccattggtgcagatggaagaatgcaagtctctcctccctccagctcccccgaaaccaaaaccctcaaacgcgtcccctgcgagacaccacccttcactcagacctcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38641 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaggcaatcccacctccctgcttcaaccgctccatcccacgctccttctcctcttcgacctcatcatctcctcctcgtcccctccctctcccacctctccccaccctcctgccctctcccttacctcgcctgacccctctactgggcctgccaaggctgcgtcctaacgggcctctgggtcatagcccacgagtgcggccaccacgccttcagcgactac

SEQ ID NO: 38642 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 38643 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38644 - DNA, 344 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 38645 - DNA, 334 bp, Artificial
  Mutation in BnaC.FAD2.b introduced by TALE nuclease pair BnFAD2_T03
caggatccatgggtgcaggtggcagaatgcaagtgtctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38646 - DNA, 319 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccatcacgccttcagcgactac

SEQ ID NO: 38647 - DNA, 441 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccatgcgagacaccaccattcactcacagcaccggcaacagccgctggaccgtctccagcgcctgcttgccaccgccaagccgtgggcctggcacagcaccggcaacagccgctggacgacctcaagaaagcaatcccacctcactgctttaaacgctccatccctcgctccttcccctcccccccctccgccatccccgtctccccctccctctaccacctctccccagcctacttccctcgcctcccccaccctctcccttacctcgcctggcccctctactgggcctgccaaggctgcgtcctaacgggcctctgggtcatcgcccacgaatgcggccaccacgccttcagcgactac

SEQ ID NO: 38648 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagactgcgtcctaacgggcctctgggtcatagcccacgagtgcggccaccacgccttcagcgactac

SEQ ID NO: 38649 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccatgcgagacaccacccttcactctgacctcaagaaagcaatcccacctcactgcgtcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38650 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgaacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggccttccaaggctgcgtcctaacgggcctctgggtcatcgcccacgaatgcggccaccacgccttcagcgactac

SEQ ID NO: 38651 - DNA, 294 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatatcccacgagtgcggccaccacgccttcagcgactac

SEQ ID NO: 38652 - DNA, 329 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaactcaagaaagcaatcccacctcactgcttcaaacgctccatccctcgctccttctcctcttcggcatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38653 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccgacctcaagaaagcaatcccacctcactgcttcaaacgctccatccctcgctccttctcctacctcctcttcgacatcctcgtctcctcctccctctaccacctctccccagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 38654 - DNA, 418 bp, Artificial
  Mutation in BnaC.FAD2.b introduced by TALE nuclease pair BnFAD2_T03
caggatccatgggtgcaggtgcaagaatgcaagtctctcctccctccagctcccccggaaccaacaccctcaaacgcgtcccctgcgagacaccaccattcactctagatcggcgatatcgatgctgtccatgtgctgtctctcgaacttggcagcggcagtctccttatcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagtgactac

SEQ ID NO: 38655 - DNA, 458 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaccaccacctgctggggggtcaagccgtgggcctggcacagcaccggcacacgttggcgtcggcaaacagtggtccggcgcacgcgctctggaggccttgctcacggtggcgggagagttgagagggagacctcaagaaagcaatcccacctcactgcttcaaacgctccatcccacgctccttctcctcttcgacatcatcatctcctcctcggctcctccctctcccacctctccacagcctccttccctctcccttacctcgcctgacccctctactgggcctgccaaggctgcgtcctaacgggcctctgggtcatcgcccacgaatgcggccaccacgccttcagcgactac

SEQ ID NO: 38656 - DNA, 404 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactctcggcggatttgtcctactcaggagagcgttcaccgacaaacaacagataaaacgaaaggctcagtctttgacctcaagaaagcaatcccacctcactgcttcaaacgctccatcccacgctccttctcctcttcgacatcatcatctcctcctcggctcctccccctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38657 - DNA, 335 bp, Artificial
  Mutation in BnaC.FAD2.b introduced by TALE nuclease pair BnFAD2_T03
caggatccatgggtgcaggtggcagaatgcaagtctctactccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 38658 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccatgcgagacaccacccttcactcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38659 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccgcgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38660 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38661 - DNA, 474 bp, Artificial
  Mutation in BnaC.FAD2.b introduced by TALE nuclease pair BnFAD2_T03
caggatccatgggtgcaggtggaagaatgcaagtgtctcctcactccaaaaagtctgaaaccgacaacatcaaacgcgtcccctgcgagacaccaccattcactctctccagcgcctgcttgccgccatcgtggctggcgatggccaccacctgctccggggtcaagccgtgggcctggcacagcaccggcaacagccgctggaccgtctccagcgcctgttgccgccagagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 38662 - DNA, 320 bp, Artificial
  Mutation in BnaC.FAD2.b introduced by TALE nuclease pair BnFAD2_T03
caggatccatgggtgcaggtggaagaatgcaagtctctcctccaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38663 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatagcctttctagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38664 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaattccacctcactgcttcaaacgctccatcccacgctccttctcctcttcgacatcatcatctcctcctcggctcctccctcaaccacctctccacagcctacttccctctcctcccccaccctctcccttacctcgcatggcccctctactgggcctgccaaggctgcgtcctaacgggcctctgggtcatagcccacgagtgcggccaccacgccttcagcgactac

SEQ ID NO: 38665 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagggcggccaccacgccttcagcgactac

SEQ ID NO: 38666 - DNA, 348 bp, Artificial
  Mutation in BnaC.FAD2.b introduced by TALE nuclease pair BnFAD2_T03
caggatcaatgggtgcaggtggaagaatgcaagtctctcctccctccagctcccccggaaccaacaccctcaaacgcgtcccctgcgagacaccaccattcactgacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 38667 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggccggccaaggctgcgtcctaacgggcgtctgggtcatagcccacgagtgcggccaccacgccttcaccgactac

SEQ ID NO: 38668 - DNA, 335 bp, Artificial
  Mutation in BnaC.FAD2.b introduced by TALE nuclease pair BnFAD2_T03
caggatccatgggtgcaggtggcagaatgcaagtctctactccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgaatgcggccaccacgccttcagcgactac

SEQ ID NO: 38669 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctacaagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38670 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcatgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 38671 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccaccgcactgtttcaaacgctcgatccctcgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 38672 - DNA, 362 bp, Artificial
  Mutation in BnaC.FAD2.b introduced by TALE nuclease pair BnFAD2_T03
caggatccatgggtgcaggtggaagaatgcaagtctctactccctccagctcccccggaaccaacacactcaaaagcgtcccctgcgagacaccaccattcactcaatggcggtggcaagcaggcgctggagagacctcaagaaagcaatcccacctcactgcttcaaacgctccatcccacgctccttctcctcttcgacatcatcatctcctcctcggctcctccctctaccacctctccacagcctacttccctctcccttccctcgcctgacccctctactcggcctgccaagggtgcgtcctatctggcctctgggtcatagcccccgagtgcggccaccacgccttcagcgactac

SEQ ID NO: 38673 - DNA, 295 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38674 - DNA, 356 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38675 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcactcgctccttctcctacctcctcttcgacatcctcgtctcctcctccatctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38676 - DNA, 352 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgagaactcaagaaagcaatcccaccgcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaacgggcctctgggtcatcgcccacgaatgcggccaccacgccttcagcgactac

SEQ ID NO: 38677 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaagaaagcaatcccacctcactgcctcaacccctccatcccacgctccttcccctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38678 - DNA, 335 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38679 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccgcgagtgcggccaccacgccttcagcgactac

SEQ ID NO: 38680 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38681 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 38682 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaccctcaaacgcgtccccttcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38683 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38684 - DNA, 332 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtcccctgcgagacaccacccttcactctcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 38685 - DNA, 330 bp, Artificial
  Mutation in BnaC.FAD2.b introduced by TALE nuclease pair BnFAD2_T03
caggatccatgggtgcaggtggcagaatgcaagtctatactccctccagctcccccggaaccaacaccctcaaacgcgtcccctgcgagacaccaccattcaccctcaagaaagcaatcccacctcactacttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 38686 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38687 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 38688 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctatcctcccccaccctctcccttacctcgcctggcccctctactgggcctgccaaggctgcgtcctaacgggcctctgggtcatcgccaacgaatgcggccaccacgccttcagcgactac

SEQ ID NO: 38689 - DNA, 392 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcggatggcctttttgcgtttctacaaactcttcctggctagcggtactcggagacctcaagaaagcaatcccacctcactgcttcaaacgctccatcccacgctccttctcctacctcctcttcgacatcatcatctcctcctcggctcctccctctcccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38690 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacaagtgcggccaccacgccttcagcgactac

SEQ ID NO: 38691 - DNA, 330 bp, Artificial
  Mutation in BnaC.FAD2.b introduced by TALE nuclease pair BnFAD2_T03
caggatccatgggtgcaggtggaagaatgcaagtctctcctccctcaagctcccccggaaccaacaccctcaaacgcgtcccctgcgagacaccaccaagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38692 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacactacccttcactccagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38693 - DNA, 346 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaacctcaaacgcgtcccctgcgagccaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccgcgcctggcccctctactgggcctgccaaggctgcgtcctaacgggcctctgggtcatcgcccacgaatgcggccaccacgcctgcagcgactac

SEQ ID NO: 38694 - DNA, 382 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccaacaccctcaaacgcgtcccctgcgagacaccaccattcactcttgacagaaccgaaacgttgaagcagccactctgccgcgggtttctgagacctcaagaaagcaatcccacctcactgctccaaacgctccaccccccgctccttctcctctccgacatcatcttcccctccccggctcctccctctcccacctctccacagcctacttccctctcccttacctcgcccggcccctctactgggcctgccaaggctgcgtcctaacgggcctctgggtcatcgcccacgaatgcggccaccacgccttcagcgactac

SEQ ID NO: 38695 - DNA, 283 bp, Artificial
  Mutation in BnaC.FAD2.b introduced by TALE nuclease pair BnFAD2_T03
caggatccatgggtgcaggtggaagaatgcaagtctctagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38696 - DNA, 414 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactctcaggcgctggagacggtccagcggctgttgccggtgctgtgccaggcccacggcttgaccccggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38697 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaatgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38698 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccgacaccatcaagcgcgtaccctgcgagacaccgcccttcactgtagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38699 - DNA, 295 bp, Artificial
  Mutation in BnaC.FAD2.b introduced by TALE nuclease pair BnFAD2_T03
caggatccatgggtgcaggtggaagaatgcaagtctctcatccctccaggtagacctcaagaaagcaatccaacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 38700 - DNA, 332 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacagaactcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38701 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagacctcaagaaagcaatcccacctcactgcttcaaacgctccatcccacgctccttctcctcttcgacatcatcatctcctcctcggctcctccctctaccacctctccacagcctacttccctctcccttacctcgcccgacccctctactgggcctgccaaggctgcgtcctaacgggcctctgggtcatagcccacgagtgcggccaccacgccttcagcgactac

SEQ ID NO: 38702 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgatacaccaccattcactctacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgagtgcggccaccacgccttcagcgactac

SEQ ID NO: 38703 - DNA, 345 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38704 - DNA, 345 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgctcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38705 - DNA, 328 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38706 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagctactac

SEQ ID NO: 38707 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggtctctgggtcatagcccacgagtgcggccaccacgccttcagcgactac

SEQ ID NO: 38708 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38709 - DNA, 317 bp, Artificial
  Mutation in BnaC.FAD2.b introduced by TALE nuclease pair BnFAD2_T03
caggatccatgggtgcaggtggaagaatgcaagtctctactccctccaaaaagtctgaaaccgacaccatcaagcgcgtaccctgcgagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38710 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38711 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 38712 - DNA, 361 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaatggcggtggcaagcaggcgctggagagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38713 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctactaccctctcccttacctcgcctgaccccactactgggcctgccaaggctgcgtcctaacgggcctctgggtcatagcccacgagtgcggccaccacgccttcagcgactac

SEQ ID NO: 38714 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctaaagaaagcaatcccacctcactgcttcaaacgctccatcccacgctccttctcctcttcgacatcatcatctcctcctcggctcctccctctaccacctctccacagcctacttccctctcacttacctcgcctgacccctctactgggcctgccaaggctgcgtcctaacgggcctctgggtcatagcccacgagtgcggccaccacgccttcagcgactac

SEQ ID NO: 38715 - DNA, 347 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38716 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacccctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38717 - DNA, 350 bp, Artificial
  Mutation in BnaC.FAD2.b introduced by TALE nuclease pair BnFAD2_T03
caggatccatgggtgcaggtggaagaatgcaagtctctcctccctccagctccaccgaaaccaaaaccctcaaacgcgtcccctgcgagacaccacccttcactctcgacctcaagaaagcaatcccacctcactgcttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38718 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcgtcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38719 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 38720 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctccctgcttcaaacgctccatcactcgctccttctcctacctcctcttcgacatcctcgtctcctcctccctctaccacctctccccagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38721 - DNA, 350 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 38722 - DNA, 317 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacctcaagaaagcaatcccaccgcactgtttcaaacgctcgatccctcgctccttctcctcttcgacatcatcatctcctcctctgctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38723 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 38724 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgagtgcggccaccacgccttcagcgactac

SEQ ID NO: 38725 - DNA, 352 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38726 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38727 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccagacctcaagaaagcaatcccacctcaccgcttcaaccgccccacccctcgctccttctcctacctcctcttcgacatcctcatctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 38728 - DNA, 431 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggctgttgccggtgctgtgccaggcccacggcttgaccccccagcaggtggtggccatcgccagcaatggcggtggcaagcaggcgctggagacggacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38729 - DNA, 348 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38730 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttccctcgcctggcctctctactgggcctgccagggctgcgtcctaacgggcctctgggtcatagcccacgagtgcggccaccacgccttcagcgactac

SEQ ID NO: 38731 - DNA, 349 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaaccggcgtctgggtcatagcccacgagtgctgccaccacgccttcagcgactac

SEQ ID NO: 38732 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38733 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 38734 - DNA, 350 bp, Artificial
  Mutation in BnaC.FAD2.b introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgtagaactcaagaaagcaatcccaccgcactgcttcaaacgctccatccctcgctccttctcctacctcctcttcgacatcctcgtctcctcctccctctaccacctctccacagcctacttccctctcctcccccaccctctcccttacctcgcctggcccatctactgggcctgccaaggctgcgtcctaacgggcctctgggtcatcgcccacgaatgcggccaccacgccttcagcgactac

SEQ ID NO: 38735 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgaatgcggccaccacgccttcagcgactac

SEQ ID NO: 38736 - DNA, 416 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactcttggccaccacctgctggggggtcaagccgtgggcctggcacgatggcggcaagcaggcgctggaggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38737 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38738 - DNA, 346 bp, Artificial
  Mutation in BnaC.FAD2.b introduced by TALE nuclease pair BnFAD2_T03
caggatccatgggtgcaggtggcagaatgcaagtgtctcctccctccaagaagcctgaaaccgacaccatcaagcgcgtaccctgcgagacaccgcccttcactaactcaagaaagcaatcccaccgcactgtttcaaacgctcgatccctcgctccttctcctacctcctcttctacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38739 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38740 - DNA, 353 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatcccacgctccttctcctcttcgacatcatcatctcctcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38741 - DNA, 379 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttgaacgctctcctgagtaggacaaatccgctccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 38742 - DNA, 329 bp, Artificial
  Mutation in BnaC.FAD2.b introduced by TALE nuclease pair BnFAD2_T03
caggatccatgggcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38743 - DNA, 358 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactctcagcggctgttgccggtgctgtgccaggcccccgctcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38744 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctagcaggcgctggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38745 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacggagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgaccacgaatgcggccaccacgccttcagcgactac

SEQ ID NO: 38746 - DNA, 324 bp, Artificial
  Mutation in BnaC.FAD2.b introduced by TALE nuclease pair BnFAD2_T03
caggatacatgggtgcaggtggaagaatgcaagtgtctcctccctccagctcccccgaaaccaaaaccctcaaacgcgtcccctgcgagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38747 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccgaggctgcgtcctaacgggcctctgggtcatcgcccacgaatgcggccaccacgccttcagcgactac

SEQ ID NO: 38748 - DNA, 333 bp, Artificial
  Mutation in BnaC.FAD2.b introduced by TALE nuclease pair BnFAD2_T03
caggatccatgggtgcaggtggaagaatgcaagtgtctcctccctccagctcacccgaaaccaaaaccctcaaacgcgtcccctgcgagacaccactcttcactgaacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38749 - DNA, 385 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccgtccagcggctgttgccggtgttgtgcctggcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 38750 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacatcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38751 - DNA, 320 bp, Artificial
  Mutation in BnaC.FAD2.b introduced by TALE nuclease pair BnFAD2_T03
caggatccatgggtgcaggtggaagaatgcaagtctctcctccctccagctaccccggaaccaacaccatcaaacgcgtcccctgcgagacaccaccattcactctatcccacctcactgcttcaaacgctccatcccacgccccatctcctctccgcctacatcacctcctcctcggctcctccctctcccacctccccacagcctactaccctctcccttacctcgcctggcccctctactgggcctgccaaggctgcgtcctaacgggcctctgggtcatagcccacgagtgcggccaccacgccttcagcgactac

SEQ ID NO: 38752 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccgaaacaaaaaccctcaaacgcgtcccctgcgagacaccacccttcactcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38753 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 38754 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 38755 - DNA, 296 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccatcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcttggtcatagcccacgagtgcggccaccacgccttcagcgactac
